United States Patent 12,642,819 (COMPOSITIONS AND METHODS FOR TREATING INFLAMMATORY BOWEL DISEASE) - sequence listing, part 3

SEQ ID NO: 2 - DNA, 3334489 bp, Anaerotruncus colihominis (residues 1,667,246-3,334,489 of 3,334,489)
  modified_base (2651915)..(2652010): a, c, t, g, unknown or other
  modified_base (3206774)..(3206865): a, c, t, g, unknown or other
  modified_base (3208402)..(3208500): a, c, t, g, unknown or other
  modified_base (3299955)..(3300051): a, c, t, g, unknown or other
  modified_base (3316523)..(3316627): a, c, t, g, unknown or other
  modified_base (3317950)..(3318117): a, c, t, g, unknown or other
aaatgcgcgcgcagcgactgtacaatacgcatgtattcggcggtatcatagtggcggcgcatgcgcgcaagcgtcgcgtcgcaaccgctttgcagcgacaggtggaactgcgggcagagctttggctgccgcgccatgcgcgcgatgtcgccgtcggtgagcaactccggctcgagcgagccgagccgcacgcgttcgatgccgtcgaccgcgcaggcaagctccaccgcgtcgatcagacgcagcccaagctcgcgcccgtaggacggcaggttgatcccgacaagcaccgcctcgcggtagccggcgcgcgccagcccttcaagctcggcgcgcagctccccgggcggcttggagcgcacggggccgcgcgcctgcgggatgatgcagtaggcgcagtagcggtcgcagccgtcctcgattttgacgaaggcgcgcgtgcgctcgcggaaggcggccgcgcgcatcggctcgaacggctcgccgcgctcgtgcggcgcgacggcgacgatgcgcccgcgcgtttcgcgcgcccggcgcacaagctcgacgagggccgcgcggtcgcgcgcgccggcgatcacgtcggcttcggccaggcgcgcggcgtcgtccgggaacgcctgcgggtaacagcccgtcagcacgacggtggcgtccgggcaaagcgtgcggaaacggcgcagcacgcggcgcgttttctggtcgccggaggcggtgacggtgcaggaattgacgacatagacgtcggcgggcgcttccggcggcacaatttcgtagccggcgtcggcgaactgctgcgcgaggatctgcgcctcgtactggttcaccttgcagcccagggtgtaaaaggcagctttcatttatacactccgtccaaattcgactgaatttgcatgtgcatgttgcacaacaaacaagccgcgcgatgcggcaggatacacatattataatgaatttctaaaacaaatacaataagcagttgacttaaagaatgggcgctgatatagtggaattgtaggaaaaacagaaataagtcatatgttcagaagaaggaggacataacgaatgaaatcagtgattatcaggctcgacaccatcaacgatgtgaaaagctttgtcaacaccgtctcgaagtacgatttcgatgttgatctcatctccgggcgctatgccgtcgacgcgaagtcgatcatgggcattttctcgctcgatctgtccaaaccgatcaagatggagatttacgcggacaattgccccgagttccttggcgaggtaaagccgttcatcattgaatgaccgccggatagaaggcacagacagcgggggcgctccccgcatgaaaaaagcggccgcccaagcggccgcttttttgagtttcagggctttttaaggttccatcttgtcggagagtccaagcagataatcggttgttacgccgtaaaaacgcgccaatgcgatcagatgatgcgcagggatttcgctggtgccggtttcccaccggctgtactgcttttgggacgtgccaaggacggctgcgacctgcttttgcaccatatcgtgatcgtcgcgcaggtcgcgcagcctgcgatagcgatacatagttcacccccgatgtcgctggtgtgtccgtaaccggacgctcatgatgtcatcccttatcatatgaaaatcacaagtttgcatcttgattttagtacaaaacaggggtaaaatagtaggcgccgcgggccttgtaagagatgtccgcttcttgtttcccacacagactgagcgaggggtccgcggcacacctttatagatccggtgcgcaaaagcagcggaaagggcgcggcactgccgcgcccttttgtttggcgtgccgctgtggtttacaaagcgcgaaatccgtatgctccccgtacagaccgcccgcagcgttgttcccagggccggcattcgccgggctggaacgcgatgaaacgcgttttttaagcctcgcagcttcgttcgtaaacatgttcggcccgcgccgcgcatacatatgataccacgggggcctgcgaacaggctctgaacgacgatgcgagaggtgtgcgactatggccaaaaagctcgccgctgttttcctggcggcagtcataatgtttgcggcggcggcgccggtctttgcggaggatgaagccgatttgacggcgctggaaacggccgcggcggccgacgattcgctgccggcccgttcggcgattctcattgaacagagcacgggacgggtgctttttgaaaaaaacgccgacgagcaattgccgcccgcgtcgatcacaaaggtgatgacgctgctgctcgtgatggaggcgctcgacagcgggcagatcgcgcttggcgacatggtgacgtgctccgaacatgcgcagtcgatgggcggatcgcagatctggtttaaagcgggcgaacagctttcggtcgacgatctgctcaaggcggccgcgatctcgagcgccaacgacgcgtccgtcgcgctggccgagcatgtggcgggcagcgaagaggcgttcgtcgccctgatgaacgagaaggcggcacagcttggcatgacgaacacgcactttgtcaatgcgacggggcttgacgccgacggacatctgacgacggcgcgcgatatcgcggcgatgagccgcgctttgcttgcttatccgaaaatcacagagtattcgggcacgtggatgtccgagctgcgcggcggagccacgcagcttgtcaacacaaataagctggtgcgtttttacgacggctgcacggggcttaaaaccgggacgacggacggcgcaggcagctgcctgagcgcgagcgcgacgcgcggcggcctgtcgctcatcgctgtaacgctcggcagccccacgtcggcggaacggttttccgcggcgcgcggactgctcgactacggttttgcaaactatacgcgcgtcgagctgccgccgctggaggagcttgcgcccgtgccggtgcgcggcggcgtcgcaccccaggtcggggttttgtccgagacgccgggctatgtgatcgtacgtaccgccgacaaggacgcggtcaaacaggacgttacgctgctgccggacgtacaggcgcccgttgagacagggcagctgcttggacgggtcgttgtccatatcgaagggagcaagctgtgcgaatacgatcttgtcgcggccgacgcggtcgaccggatgacggcgccgcgcgcgctgagtatgctcctgcgcgcgcttgtgcagatctgaaagctttttgcgccgaatgacaggaaaaggcttgaaaaagaagtgcaaatcaggtacaatatgtgtaagaaagaccgaatacatcgcgtgtcgaattgtgcgatttgtacaacgtaaaaatgggaaggaagtcctggacatggcaatcaagctgaacagcaaatatctcaagggctttgtaaatgaacacgaactgcgggcgatcgagccgcaggtaaaagcggcgcaccgggtcctgtccgagaaaacgggacttggaaacgattttctcggctggaccacgctgcccgccgactatgaccgcggcgaattcgcgcggatcaaggcggcggcggcgcgcatccgggaggacagcgacattctgctcgtcatcgggatcggcggttcctatctgggcgcgcgcgcggcgcttgaattgctgcgcagcccctattataacaacctgaaaaaggacacgcctgacatctattttgtcggcaacagcatcagccccgattatctgaacacaatcctcgcgctgtgcgaaggcaagcgcgtttcggtgaacattatctccaaatccggcaccacgaccgagccggcgctcgcgttccgtgtgttccgtgagctgcttgagcagcggtacggccgcgacggcgcgaaaagccgcatttacgcgacgaccgacaaggcgcgcggcacgctcaaagagctgtccgaccgcgaagggtacgagacgtttgtgatcgccgacgatgtcggcggccgctactccgtgctgacggccgtgggcctgctgccgatggctgtcgcgggcatcgatatcgacgccgtcatggctggcgcggccgatgcgatgaaggcgctcgacaacgacgatctgtgcacaaacgactgctacaagtacgccgcttaccgcaacatcctttaccgcaagggcaaggcggtcgagctgcttgtcagctacgagcctgcgtttgcgatgatgaacgaatggtataagcagctttttggcgagagcgagggcaaggaccagaaggggattttcccggcgtccgtcgtcttttcgaccgatctgcattcgatgggtcagtttatccaggagggcagtcgcatgctctttgagacggttgtcgatatccagaagccgtcgaaagagttctttgtgaaggacgatccggaaaatctggacgggttgaatttcctgtcgaatcagaacatgtcggttgtcaaccgcaaggcgatgcagggtacggtgctggcgcatacgcagggcggcgtcccgaatatgctccttgaggtgcccgaaatcaacgagcatgaattcggctatatggtttatttctttgaaaaggcgtgtgcaatcagcggctatctgctcggcgtcaatccatttgaccagccgggcgttgagagctataagaaaaatatgttcgcactgctcggcaagccgggctatgagagtgagcgggcggcgctggaggcgcagctcggctgacacagaaaagcagcaggattccaaaatttatatattgggaggaatttcatatgattaagctgatcgtcggcaacaagggttccggcaaaaccaaaaggctgatcgacatggtcaacgacgccgttaaaacctcgaaaggaaacgtggtctgcgttgaaaagggcaacacgctcaaatttgacgtgagtcatcaggcgcgtttgatcgatattgaggattacgccgtctccggctttgaaatgttctatggctttttcagcggcctgtttgcaggcaattacgatattaccgaggtgttcgtcgacgccacgttcaaaatcggcggcaaggatttcgaggcgtttgccgttatgatcgaccgtttggccaggctgctcggcgaaaacggcgcgacgatgacgtttacagtctcctgcgataaatccgacctgcctgagcgcgtgcatcagtatatcatctgagccgcgcgatacaacgggataatctgacgccgcgccgcatgaaaatgcggcgcggcggtttttccctgtgcttctgcgcagaaaaaaggtctccccgccgtttgcctgcccccgacgggcggccggacgcgatgcgggtaccctttgcgcgcaggtggttttgcgttcatcgcggtgtacggaccgccgtgaagttttatggggaagatcttgacaggcaatacaaaattgggtataataaacttcgtgacatttgcgggggcagtgggtccaaatccgcaaatgcagtccctgagtatcgaaccctgaacggagtatgcagtatgaaggtcgatctttccgagctgtttgacaatccaggccgcgcgcaggatttttccggcgaagtggaccttgcggacgtgaagcggcacggggacaggctgtttgaaggccctgtcaggatcgccgggcgcgcgcagaaccgtgcggggatcgtcagcattggctatcaggcggatttcgtgctcggcgcggtatgcgatcggtgtcttacgccgctgtcgcgcccgcagcatctggaattcacgcacacggcggttttatccctgaaccgtgaggacaacgatgagtatatagtagtatcggacgggcagcttgatttggcagagctggctaccgccgatattctcctcgaactccccacctcggtcttgtgcgtcgaaagctgcaaggggctttgtcctgtctgcggcgcaaatctcaacgaaggggattgcggctgcgaccgctcccagcgcgacccacggctcgataagctgcgggagctgctggacgaataagtgaaaaaaagaatgcccgcgccctgcgggcgcggtatgtcctgacatacgaccacgaaaaggaggcgccctaagatggcagtaccaaagaggaaaagctcgaaagcacgcaaaaacaaaagacgttccaacgtctggaagctggaggcccccgcgttctcgaagtgcactcactgcggcgaactgaaaacaccccacagggtttgcccgagctgcggctactacaaggatcgtgaagtgatcaaggtcgaggcgtaagcacgccggtgacgatggaggcggaaggaattccgcctctttttgttttacagacgcattgcaaaccggccgtgcgccgcctgcggcgtgcggccgtggaatctgtgcgcacaggccgcatcatgggagtgtaaaaaaatgccagtcctgattcaaagcgtcgagccggcgtcatacgcggcgcgtgcgggcatccgtccgggagatacgctgctggccgtcgacaggcatccgattgccgatgtgctcgattaccgcttctatgtgacaagccgccgcatcacgcttgagctgcttcgcgcgggcaagccctttaccgcgcgcatttcaaagggcgaatacgacgacatcgggctggagtttgaaacgtatctgatggacaggcagcatacctgcaaaaacaaatgcgtgttttgtttcgtcgatcagatgccgcccggtatgcgcgattcgctctattttaaggatgacgacagccgcatgtcgtttctgttcggcaattatattaccctgaccaacttgacggatgccgatatagaccgtattataaagatgcgcatctctccggtcaatatttctgtccatacaaccgacccggcgctgcgcgtacagcttatgaaaaatcctcatgcggccggcagcctgcgctatatcggccgcctgaccggggccggtatccgcgtcaacgcgcagcttgtgctgtgtccggggctgaacgacggcgcggcgctcgagcggacgctttgcgacctcgacgcgctcgggccgaacctccaaagcatcgcgtgcgtgccggtcgggctgacaaagtaccgagacgggctgcctgctctcaagccctttacaagcgagggtgcggcgcgcacaatcgatatcattgaacggtttgccgcgcgccagatcgcgcgcggcgcggcgcgcacggcgtatccatccgacgaattttttctcatagcgggccgcccgctcccggacgtcgaatattacggcgactttgaccagcttgacaacggcgtcggcctgctgacgcttttggagagtgaattttcctcggcgctcgcgctcgacggcgaggacgcagcgcctgccagcgccacgctggcgactggcgtcgccgccgcgccgcttttaaaaaggctggccgcgcgcgcgatgcagcgccatcccggcgtgacggtcgacgtgcgcccaatcgtcaaccgctttttcggcgagacgatcactgtggcggggcttatcaccgggcgtgatctgatcgggcagctcggcggcgcgccgattggcgggcggctgctgatcccatcggtcatgctgcggcatgaacgcgaccgttttctggacgatgtgacggccgatgaggtagaaagaacgcttggcgtcaggctttgcgccgtcgacaacgacggctacgcgctctatgacgcgatgaccgggcgcggctgaggtgttttgatggtcaacagcccccttgacagcccgcgtggcgggcgtcggaaaggaacagacggatgagtaaaccattgattgcaattgtaggtcggcccaacgtgggaaaatcgactctttttaataagctggcgggtgcgcgcatatccatcgtggaggatacgcccggcgtgacgcgcgatcgcgtctattatgaatgcgagtggcgcgccaagacggtcatgcttgtcgatacgggcggcatcgagccgtattctactgacaaaatcctttcgcagatgcgccgccaggcgcagcttgccatcgacagcgccgatgtgattattcttgtgacggatatccagtcaggcgtgacggcgaccgaccaggacgtcgctgtgatgctgcaaaaaagcggcaagcctgtggtgctggcggtcaataaatgcgaccgtctcggcgatgtgccgcccgatttttacgagttttacaacctcggcctcggcgacccgatcgccgtgtcgtccgtgcatggacacggcaccggcgacctgctcgatgcgtgttatgcgcatatcgattttaaccgcgccgacgagtacggcgaagagtatgtaaaggtcgccgttatcggcaagccgaacgttggcaaatcgtcgcttgtcaaccgcgtggcgggcgaggagcgttcgattgtctccgacatggcgggcacaacgcgcgacgccgtcgacacggttgtcgaaaacgaatacggccgttttgtgttcatcgatacggccggcatccggcgcaagtcgcgcgtcgaggagcagatcgagcggtacagcgtgctgcgcgcatatatggcggtcgaccgcagcgacgtgtgcgttatcatgatcgacgcgacggtcggctttaccgaacaggacagcaagatcgccggctacgcgcatgaacgcggcaagggctgtattgtcgccgtcaacaagtgggacgcgattgaaaaggacggcaaaacgatgcagacgttccgcaaaaagctggagacggatttttccttcatgtcctacgcgccgattctgtttatctcggcgatgacgggacagcgtatcgataagctgtttgagcagatacaatatgttaacagtcagaacgcgatgcgcatctccacgggacggctcaacgatatgctgtccgtggccacggcgcgcgtacaaccgccgacggataagggaaagcgcctgcgcatctatttctgtacgcaggcggcgacacgcccgccgacgtttgtatttttctgcaacaacagcgagctgtttcatttttcctatcagcgttacctggaaaatcagatccgtgaaacattcggcctgtccggtacgccaatccgcattgtggtgcgtgagcgcggcgataaaaaacggtaacgcccataaaccgacggaatgatgataaggggtgtgatatcattgagcgtgaagttctggtcttttgcggcgattgtcgcgctggcggcttatctgatcggcagcgtgagctttgcggtgatcgtttcgcgcgtcggcgcacaggacgatgtgcgccgtcatggcagcggcaacgccggtatgacgaatatcctgcgcaattacggtaaaaaaatggcggcctttacggcgctcggtgatttcggcaaggggattgtcgccgtggcggtcggacgcatgatctttacgttggcggggattacagtgcttgacggcggctatatcgcgggctttttcgtggtgcttggccacctgttcccgctgtatttcggctttaagggcggcaagggcgtgctcacaagcctgggcgttgtgctgatgctcaactgggttgtgtttgcgctgttagtcgtgctgctcctgccggttgtattcatcgtaaaaattgtatcgctcaccgtgatcatcgggtatatcctgtttccgtttttcacactgctgatcaattatatcgaggggcagccgcttctgtttaactttgcgttcgcactgctgatgagctgcctgggcgcttttatgcaccgcgaaaatatcaaacgcctgctcgccgggacagaataccggtttgggcagaaaaaggaaggctgacgacaggaggatctgtatggcagaaattttgattctcggcgcgggcggctttggcacggccctggccatcatgtgtgcgcagaatgggcacgatgtaacgctgtattcaccgtttcaggaggagatcgagacgctgtccgccgcgcgggagcataaaaagcttttgccgggcgtgaaaatcccggagacagtcaaaatggtgtgggagcttccacagacggtcagcgcgccgttggcggtcgtggcgacgccgtcgttcgctgtgcgcggcgtctgcgcgtccatcaagggacgcatcggccgtgatacggttgtaacatgcgtgtcaaagggctttgaaacagggacgcttaaaacgctctcgcaggtgatctgcgaggagctgccggaaaacagcgtcgtcatcctttccggcccttcccatgccgaggaggttgcgcgcggcgtcccgacgacggttgtcgccgcgtcgcgcagccgcgcggctgcggaatttgtgcaagacacgctgatgaacccgacgctgcgcatttatgtcaacgacgatgtgacgggcgtcgaactcggaggcgcgctgaaaaatgtcattgcgcttgcggccggcacggctgacgggcttgggcttggcgacaattcgaaagcggcgctgatgacgcgcggcattaccgagattgcgcggctgggcgtggcgatgggcgcgtcgacggagacgttcgcggggctttccggcatcggcgatttgatcgtaacctgcacgtcgatgcattcgcgcaaccggcgcgcgggtatcctgatcgggcagggcaaaacggcacaggaggccatcgacgaagtggggatgaccgttgagggctacacggcggcaaaatgcgcctgggagctggcgcagcgtgccggcgtggagatgccgattatccgggaggtctacgccgtgctgtatgagggcaagcgttccgacgccgcgatccgcgacctgatgggccggcccaagcggcatgaatccgaggtcatttggctcctcagccgctaagagaggggcctttaaaaaataaaacatccgccgcgtctaggggctgtttgaaaaatcggaaataccgtctttttctacaaacagcggtgaatccagcgttaaaaagcctcggaatccgaagggttttcggttacaaggaagtatatttttcaattaggcggtatagccccgttcaagggctatgccgtcttttcctgtttatcggtttctttctgttccgtctgcgggtcagtcggcaaatggatttctcccacgaagttaaagataatatccactttctgaaaacgcttgccgtctatcttctccggcgcatggacaacgattttctttataaactcattgacgatagtgggagttaattcggttattcccacatacttgcggataatggtagcgaagctgtcaaaatcgcttttattctgttcgtaggtatcgacttcctgttgttctgcctttaccttttccgtcagctctttttgttctgcttcatactctgcggacagcttcaaaaatcgctcatggctgattgtgccgttgatgtcgtcctcataaatccgcttgaaaatccggtcaagttccgcaatccgtttccccttccggacttcctcaagcccttccggtttcacttcggttctttccttctcgttgttcatttttcaaggtgctgtgcgctgtcgtttgatcggcgtttgtgtcgttcgcacgaggcagcttttgtataataccacacacattattttttgtcaacacttttttcaaacttttttccgaaaaatttcctcggcttgatttcgcccctttaatgggatatcatgaagctatcagagaacaaatgaaggtgatagaatatgccgatcaaaatccccgacagcctgccagcctcgcgtatcttagagcaggaaaacatctttgtaatgaccgagcatcgcgcgctgcatcaggatattcgcccgttaaaaattgcgattctcaatctgatgcccaagaaaattgaaacggaaacgcagctgttgcgcctgcttggcaactctcccatacaggtggacatcgagttggtacaggtcaaatcgcatacctctaaaaacacgccgtccgagcatctttttaaattttataaaacattcgacgatatccgcgaccagcgttttgacggtctgattatcacaggcgcgccggtcgagcagatggcctttgagcaggttgagtattgggacgaactttgcggcatcatggagtggagcaaaacaaatgtcttttccacccttcacatttgttggggcgcgcaggccgctttgtactaccattatgggattcacaaatatccgctcgatgagaagctgtttggtattttccagcaccggctggtcgttgagaatcatccgatcacccgcggattcgacgaactgttctttgtcccccattcgcggcacaccaccgtttcccggcgtgagattgagcggtgccctgagcttgagattcttgcggtttcaaaagaagcaggtgtctacatggctggacggcgcgacgggcggcagtttttcatcaccggccatgcggaatatgaccgcggcacgcttgccgatgaatatttccgcgatctgcaaagaggccttccgatccatatcccggagcactatttccccaataacgacccggtgcagacgcctccgcatatctggcgcggccatgcgaatctcttatactgcaattggctcaactattatgtctatcagaccacgccgtatgagtttacggaaggcgtggatgaaccgtcctaaacaggagcgcggacctgatccaaaaagaccgggtccgcgctcctgttataaagcctttctgccgatatatacaagctgtgtacaccgctgtataccggtctgagcgcagcgcgtctggatggatttcgcctcgcttaaaagcgtctcgtattcgggccttccgcacgcgtgcttttccacggcgcggacgagcttttcgtttttctccgccagcttcgcgtccattttggactcctccaaaagctcggtggttttcacatcagtcaacggcagccggcttagaatttttataatctcatcctttcgccaggtggggcgctgaaatccgcctgagagcatatccagcttcgcttcgaagcaatgctgcagaaaatgcgtctgctgcgcctcgttctgtccatcggaaaacatctcgttgactaaaaaaacgccgccgggacgcagaacccggaacatttcgtccagcacagcgttgtagttctcaatatgatgcagggtattggagattgccgccagttcaaatgtattgtctgaaaaatccatatgggcgccatcccccaggacaaactccacaccctttcctgcgtttttctccttcgcctcctccaccgttttttcatcgcaatccagaccgatgacacgcgatcccgccggcatggcctccgccagcgtaaacgcaaactccccataccgcgtccccacgtccaaagccatccccggccttagaccgggcaggaattctttcaaatgcagcattaccgatcttcctttcacgttgtaaaagcccgtttaaaatcccggcgcggattttaaacaggcgtccaaggccgcctccgctcgccggaggcggcctttttaattttgtagaatcaattttatttaagcgtctaccaacacaattcccaagcgttttgcggccgcctgcgcttctggcagggacggatcggcgccgcgcagaacaagccgcccgccgccgcgattgagcgtatccaccatatagctgccctgatctgtggtgatggtgattttctgaatggcgtgctctgtcccctcgacaatctccacctcaatgcccgcgtccttaaccatctggaccgacttgttatacatctcgtaatccgaggtggacgcgccgaacacggcgcccatcagaacgccggggatattgatggagcggcgcgcaaacaattcaggatacagttcaacacgcacctttttaatcttgcccttgacaagctcatgacagatgcgcgcagcattcgtcgggctgcccacagcctggctgctgccgccgacaacggcgtctcccagggtatgcaggatattttccgtgccctgcgccagttttttggctttggctttggctttggcaagcgtctcctcaatctttttagcctcagcgtccttaacctgctgacttaccagggactccacagcgggtttgcgcttaaagaacggctccatatactccacaacgatgggcacaagggaatgtccggactcgatatgaacctcggccgccatagccagcatgacgtcaaacggcacattgaccgtcatatccaccttcatgcacaaacgtcccgcatacatccccatcaggatcgccccgcccacatgcgtggtacacagcgcgggcaccagaacgcgcggcgtgcagggtacgccgatggtaggcgacagcgccagcaccatagccttttccatctgttctggcgtgccgccgccgatggagacggtcgccgcggcaatacaggcggagcctgcgccgtagccctccatgttgcagccggtcgtgaccttgccgacccggaagatgctgccgatcttaatcatcagcgcagccgtctccgcaatagttttttcatcgtatccatgcgtcatcatcgccttgataaagccggaatacggacaggaatcgcctgtaccggcgcaggggcgcaggccgatacagtggttgcccacctgtgcgcccagcgtatacaggagggcgtcatccaaaaaggggtccgagaagcacttgggaccctcctgcgcggcaagctgcgaggctaccgtaccaagcaggatgctctcgccgtccttgacgccgatttccacagccttaaggttgtgggcgtattcgttcataatgccggtgagaatctcctcacgggaaaggcccgtgcgcagctctgtctcaataagaaccacatctgtcacgcgggcaccgaactgcttggcgacgtcgatcatctcgctgacggtaagcggcagcttctcctgaatcacagctctgatatcgctcattggatatccctcctttttgctcctgtacggatcacttgaccacgcggccagtggcataattggcttcgatctcgcgaatttcgggcaggcccacaatctcattgaactgagcgaagggaatcattgtgtcaatcagcgtttgtgtcgtatcgtcgcggcgcatcccctcccagagatccaccatggctttggtggtcacatagacggaggcggtcggatagataatcaggttatagccaaattcagaaagctgtgcgtttttaaacatgggcgtgcggccgccttccaccatattggccagcgtcaggacgcccggaagctcctcgttgatacggcgcatttcagcctcggattcaggcgactcaacaaagataatatccgcgccagcttccttgtaggcatgcgcgcgctccatggccgcgtcgatgccgtgcacggtgcgcgcgtcggtgcgggccataatcatgaagttgggatcgatgcgcgcgtccacagcggcgtgaatcttgccgaccatctcctccatagggataacctcgcggccgatcatatggccgcacttcttgggcatcacctgatcctcaagctggatcacagccacgcccgccttttcatactcgcgaacggtgcgcatgacattgacggcgtttccaaatccggtgtccgcgtccgcgatcaccggcacgccgcagcattccaccaggttggccgcacgggcgaccatctcgctcatcgtcataagccccacgtcgggcttgcccagatggctggctgactggccgtaaccggtcatgtacacggcgtcaaagccgagctttccgatgatcttgcctgtgagcatgtcgtgcgcgccgggggcgaccactgtttttttgctggcaaaaagttcgcgcatcttcttaggtccgttcatattccaatcactccattttttcatatgttgggcggccggcagacacatcgggaccgaaataaaccacatgtccgcctgcgactttgccggcccgcccgaattcatccggggcgtttcatgccccgccgcactaggggctgtttgaaaaatcggaaataccgtctttttctacaaacagcggtgaatccagcgttaaaaagcctcggaatccgaaaggattcctgtgttttttgccttgtattctcctgctgtctgcgaaaaatccggcaattcccctattttcaaataagccctaacttcccgtatattccttgagaaaactgaacgcggcgtctggatagtatttgccgagcacgcccatggcgtacagaatatagtcgcggtcctgcacaatctgcggcttctcctgcggcaacagagagatacccggatcttcaaagcagcgcagcaccatttcctcggccgcctgtttgtccgaatgaacaaagatgccgcccacacacagtacgcgctccacgcggcgcagatcacgtccaatggcagtacccgccataatccccatgaccggatcggccgtatcagcataatggcccgcatgacgccgcagggccgtattgatggcgcaggtggccatcgcgcgctccagggatttttcccgctcgtcggccgggatataatcggggtggtcctccagatgctgggcaaatcgaagcacctcgtcgggcgtgacgccgtaatcgccgtccatagccctgatcaccgcattgggaccgacagcctccgggatgccggtcgccgacacgcgcagccccagattcccctccacggtgcggtaggaaaactgcttttcattgttgatgatcagtccgcgttcctcgatggagagcttctcaagctccggcagggcggagtggatatccgtggtcgcgcctccgatatctaccaggatcagcgagccggcaccctcctgctcataggtgcccttggccagcagctcgctggccagaagcaccgcaccgggcgtcggcaccacagcctgatcggacaggccggcgcgaaattccaccaggcccctggccctggtgatctgcctgataaactgttcgtggatggcctcgcgggccggcttgatattcagctcgtgaatcgtcggcatgatattcggcacgcgtacataggcgacgcccgctttgtcaaaaagctctgccactgcacgctgtgcatacttgttgcacgccacgatcacggtcgccttgccgtgcagctcgcagatcatctccgcgttttccagggcgcatccctcgtccccgccgtctgtcccaccggaaagcaggatgatgtcgggattaatctccatcagcacttccctgcggaaggacaacggctcctcggcggaaaccacctgcatcacccgcgcgccggctgtcatagccacctccttggcggccttggcggtgacgcgcggcatatatccgagagcgaccatacgcagccccccggcggcggaacaggagctgtaccgtttcatctccgcagcaaattgcacaccctgggcttggatagccgcctcggctctgcgcgcgccttccataacgtcgtgcagcgtggtgggcgactggccgcgccccaggaaagtaaagcgcctgtccttcagcgcgaaggccgccgccttggtataggtgcttcccacatcataaacaaggatattggcctgcatttcaaccacttccatcagggctgttttccgtagattttagaggtctctacatagacatacccttccataatacgacgggctgtgcgctcaaaagcggctttttcgacatggccgtccttcacatccgccaccacaggcagcacgccggcaggatgaccgatgcggatgcgggtcttgtgctcaatatcagggatgacctggttgacgatggtgcccggaatcttggcggccgcgccggtgcaggcggtagcggtacccgcgtatgtcttgtgaagcacctgcatgaacatcagcctggccacgaaatccacctcgtcggccttgatcgtgtttccggtcgtaaagtccgtgtaatccgccggggccgtgacaaagcagatcatcgggaaagcgggagacttggtgcgggcttcctcctcggttttacacttgcccatcatcacagcgcccttggcgcgcagctcctccagaagctccagcagcgccttgttgccgttgatctcgctgggcgtctcggtgcctttcatcccaacgtcgcttgcgcgcacaaagatgcagggattagccacgtcgaccattgatgcttcaatagcgcctttgctcgtctcaatcacatccaccacgttcccggtggggagcagtttgcccgtggccgcgcctgcagtggaggcgaaatccatcagaatgggggcgcttgtgccgggcacgccgtcgattttgcagtttccagagacaacggccttcccgtcgcgcacctccacctcggcacgcaggattttgcctgtgttggtattgtggatgcgcaccatggtaacgccctcctcggcgcggaccatgctttcatcgatggcaaagggaccgacgccggaggaaatattgccgcagttgccgctgtaatcaatcaccgtaccgtcgatgctcacctgtccgaaggtgtagtccacgtcggcgtcgtcacgggtggaagggccgatgatagccagcttgctcgtcagcgggtccgcaccggccaggccgtcgatctggcggacatcggggctgccgaagatggcgaggatggttttatcacgcagggcctggtccttgggaagatcgttttccttgataaaaatgcctttactggtacccgcgcgcatgatcacgcagggaatccgcatctgatcgctcatatctgacattcctccattcatctgtttttctttttttcttcaatcgctttggtaatgcagtcaacgcacgcctgaggatcggagcctgggccgaaaaacgcgtccacgcccaaaaatcccacaccctcggactggattttgtcctcgtaatacttgtgttcttcttccttctcagcgatacgtccgccagcccacacgaccattttgtcccgcaggccaagctccttgagacgcttctccacgcgcgggaacagcgtgacgcccagccccagcaggttgctgacgcccaccgcgtcggcgttggcctcggcggcgacctccgccactgtctcaggcaggttcataccgcgcaggaacactacatcgtaccccgcgtcctgaaacgcttcgcggatcacattgatgccgttgacatgcgcgtccgctccaacggtcgccaggacgatcttctccttgcgcgtcggcggcttttcaatatgtaccgtgacatgctccttggtgatgggacagcgggacgcgtcgacgccaagaggcgtatacccttcaacatagcgggtaataccgtccggatcgcggttcgtcttaacatagcgtttgaggtcccatccgccggcgcgcggggtatccatcataccgctcttgccgccctcgacaattaggtcgatcagttccgtatcgctccactgatgccagaattcctccgtaaggcagccgggcttcaggctgcgggacggcagatgaaggacggcctccagaacggcaaacgcctcatccatcatcatggattcatactcgtcgatgaccggcgattcgatacccggattataggtgcggcggaacacgtcctcggacgcccaaaccgcctgccccatggagtcgccggttgggatgcccacggactcggcagccttgggacggtagaagttcgcgccgccaagcttcgcagagatcgccatgcgggcaaaatgcgcctgctccgcgatcaggttggccggcgggttctggaatgtctcgggaacgacgatcaggctcttggaaagcatattgtggcggaaggcgcgcataatggccaggtcgcggtagaggttgttgccgcccacgttcatctggatgccgctcagttcccagggcagcccgccgtgcgccgccaggccctcggccagcaggcacatcgcgatggccatgccgtccgtgccgccgatgttgttgatatgcttatgtgtgtcaagctgcgcgaatatcttattttcgccgcagatctgaatcgctttgtagccgttgacaaccttggtgcggaaatcatggatgccgcggccgccgaaatgcacatggatgacgggcccgatgtccgtgccgtcaaagccggcgatcagggcgtttaagatgttgatatgcgccgtatcgccggtggcgttgatgcgaacgggatgcttggcgccgccgcccatctggatgaattcgcgctcgcccttcggcgtgatgccgcccttgcccctggactgctcaatcagctcgcgccccttgagcgggtcgatgtggcgggtggcctcggagtggacgaactggaagatggtgtcgttatacatatccgcatatttgtagatatcacacgattccttccaagtttcctcagccgagttgcgccccagaatcggattcaggcacgggacgcccgtctccagcgccttctggccaagctcatagatgcggtagccgctgcggacaacgcccgccacctcgcgcggatacggtccgggcagccccacgacctcgccgttctcgtccaaatccggcatctccacgccgaagcagtcggcataagcacggatggtttcaatgtcttcctttatgatttgctttgttttttcctgtggatctttcatatatatcccccttatcgctttcggatgcggccggcgtttcccggccccttcccattgttaagcaagcccaagttcggcgcggacgcgggggatcagcccgccgtattccagcgtctttaatacgttcgcagccaacggtgcaaactgctttacttccccgtttaccgttacagtccccttctccaggtccgcctctatgatatccccggtgtgaagactgtcagctacatcggccgcccagaccggcaggccgatattgatggaattgcggcggaaaatgcgcgcaaagccctttgctatgaccagcgacacgcccacctgcctgagcgcgataggcgcctgctcgcgggaggagccgcagccgaagttgcgccccgccacaaggatgctgcccggctcaaagaccgatttaaaatccagacctgccagaccagccatggcgaattttccaagctgatccatcggctcggccatcgcatagccgggaagaatctggtcggtatccacgtcgtcccccaaaacgattacttttcctttgatgatatccatagtcagccctccgcctttggtacggtgatcctgccggcgagcgcggttgccgccgccgttgcaggagaggccagataaatattggccttcatactccccatgcgtccagggaagttccggtttgtggtggaaaccaccacgtcgcgctcgcttgtaagcccctcgtgcgcgccaaaacagggaccgcagccgggattgagcaccgtagcgcccgcgtcgcggatgattttacaccagccgcgcgcctccatctcctccaggacgtccctggaggcaggaacgatcagcgtattcacatcaggatggacgtgttttccctcaaaagccttcgccacctgctccatatcgttgatacgtccgttggtgcatgaacccactaccacctgggtaactttgacgccttccacctcccggaccggaaccacattggccggcgagaagggcttggcgatctgcggctccagcgcggacagatcgacctctcgcgtctcggcggtatcgccttcccgcgcggttgtaccaaacagggtaatcatgctgccgatttcaattcccatattgcagacagtcattcgttcggccacggaaaattcctcgataccaggtccggtgaacaaaagcgccttgtccaccagataatccgtgccaaacacactgcccaggtaaaggattaaatccttgccgaatacgttggccggccgctttccgttcagatagatctgaacgacttccggcacctccagatcaagcctgccggtcgccatagccgcggcaagctctgtggaaccgacgccgataccgatggcgccgtatccgccgcaggttccggtatgggaatcggcgatagcaatcagctcgccgggcgccgcgcggtgcttttcatacatcagctgatggataacgccctcgccgcgctggtaaagatgcacgccgaattccttggcaaaatcgtccatggcccaaacgctgttgcgggccttttccgtcgcagccggatagatatgatccacaatgagaaccacacgatccggatcaaacaccttgctgacgccgatttcacggaacatcttaatcgcgattggagcggtcacatcgtgggcggccacatagctgaccttgcaggaaagatcgtcccccgcgtgcgcttcggcaacaccggcagccttcgccagatatgtttcgatgatattcatagagtctccattcactccgtttcataggattttgccgggctgtgagcctatccccaagcccactttgcgcgagcttggagacaggctctctcaaacaggccgggacaatcaggtcattctgattatcctggcctgcccgtcccggtgcggaccagaccggaaggcccgcctgttccggcgcttcgccatagaaaagcgcgcaaaggcggaattttccaacaggccctcgggccgcgaaaggcgggggatgcccgtggacatcccctgcctttgcgttatttcttgtacagttcgcgcatgatgtcgagatgctggatgggaagcttgccaaagcggatgttcagggcgttctccacagcatcggcggtggctggaattgttgggatcagcgccggttcgccgacgccctttgcaccgaagggccccgttttgctgctgccgctttccacaacaatgggataaatggtcggcgcgtccatcgcggtagccagcagatatttcgagaaaacagggtttgtgatacggccatccttcgtctcgatcttctccatcagggcaaatcccgtacccatgaccacgccgccctcaacctgaccttcaacggcctgcctgttcacggcggttcccacgtcgtgcgcggaaacaacgttgagcacatccaccagtccggtttccacgtcgacctccaggtccacaatggtagcggcataggaatagacctcaaacggcacgccgaacatatcctcggcgttgagtcccgtggtcctggggttatacgccccggagccgagcgccagcttgccaaggcgtttcatctcgcccatcagctccggataagtcatcttgacgcttctgtcctcggaggaatagatttccctgtgacggaaaacaagtttatcctgcggcacattgagataatttgaagccacctcggccagtgtatttttggccatgcgggcggccagcatggtggcggaaccggatataaaggtctgacggcttgcggaagtcgccccaccctccggagtgacctcagtgtttgcaaaggtcacgtggatgtcctcatattccagtcccagttcctcggcggcgatctgcgccatggcggaggtggaaccctggccgatatcggcgcatccgaccatcaggttgacgctgttgtcgggcagcacctcgacaaacgcgccggccgggttcggaaggccggtgttgccgatgccgtaatacatgcagccgtagccgcggccgcggcgtttgttgggcgctgttgggacgcagggcggcagaacctgactggccttgtcgcgcaccgcctcaagacactgcacaaagccgacgttttcatcaagcacctggccggtggaggtaacgctgcccggacggtgcgcgttgataatgcgcagctcaataggatccatgttaagcgccttggccaacgcgttcatctgtccttcgtgggctacggccacctggggaacgccaaacccgcggaaggcgcccgccatggggttatttgtgtaatagaaggtcgcgtccacgcggacgttcggcacctcataagggccggcggcatggacgacagcgcgcgtgataacggcgggtccataggaggcgtaagcgcccgtatcggccagcaaggtcgcctgaacagccagcaccttgccgtccttggtcgcgccggttttatagtgcatcttgaacgggtgccgcttggaggaaaccatggtcgattccatgcgtccgcggacaatcttaacagggcgcttggtataataggaaagcagcgccgcatggcactggacggagatatccagctttccgccgaaaccgccgcctgtggtaacctggacggaagacacgcggttttgaggaaacgccagcattccggcgatttctccgcggtcataatgcgggttttgcgtggagctgtaaacgatcatctgtccgttttcaaagctggcgacgccggcgtcaggctcaatgaacatatgggacagcatgggcgtctcataatcgttttctatgatcacatcgcagtgtttgaaggcttcgtccacatcgccgtgctcaagatgctttttctgatggacgtttgtttcaccgtgcaccttgggcgcgtcctcctcggcggcgcgctccatggtgagaatcggctcgtattcctcatactccaccttgatggcctccaaggcgtcgcggacaagctccggcgtttcggcggccaccacagcgatggcgtcgccataccggcggattttgtcatccacaaggatcggctcgtccttgaggatgatgccaatcctgttcttgccggggatgtccttgcttgtcagcacacacaccacgcctgggatttccagagcggcggacgggtcaaagttcttgacagcgccatggcagatggtgctgcggaaaacgccgccgtagagcatgttcggcaactccatatcggccgcaaacttggcgctgcccataatcttctccatggtgtcctttttgacaacgcttttgcccaggatggaccagtcgtgctgaccggcgacggagacatccacagagcttttttccttgacagcgacttctgtttttttcattctctgacgcctcccttcgcatcgcgggccatctccacggccttgatgatcttgctgtatccggtgcagcggcagaggttgccggacatggcgcggcggatttcctcgtccgttgcgtcgggctttttatcaagcagcgccttggccgaaaggaccatgccgggcgtgcagtagccgcactgcacggcgcccgcgtccacaaacgcctgctggatatagttgagctggccgttttctgaaacgccttccagtgtcacaatcgtagaaccgtccgcctgtccggccagcatcaggcaggatgtgacggccttgccgttgtaaatgatggtgcaggccccgcattcgccctcgccgcagccctccttgacgctggtcatgcccatatcctcacgcaaaaagtccaccaggcgcttgttggggtcggcggtgacagagacgtcattaccgttcaggttgaattgaatcttgatctgttccatattggttcttttcctccctcacgccagaccgaactgactgatgatctgatcgaagcagcggcgggccgctccgcggacgccttcgcgcttatagacgacggaaggccgtgttgggatcgccgcctggacggcgtctgtaaaagcgggcagcgtatcgtccagagattgcctggtgagcgcgcggcccttcaaaagtgcttccagctcaggggaacgcatgggatgcttgcttaccgcgcccagcaccacacggcaatcctccaccttgttgtcaggggtgcgttttatatagatggcaacagccagtacaacgatcgccaggctcttgcgcttgccaatcttgaaatatcctacggcctcgtcgccggaaagcgcgggaaaccggatctccgtgagcagctcgtcaggacggatagcgcagttgccgggacccttgttgaaatcctcaatcgtcatgacgcgctcgcccccggcgcttttaagaaccacctgcgcgccataggtgaggaaggtggtggggctgtcgcccgctacggatgcattgacaacgttgccgccgacggtaccgagattgcgtatctgcggtgaaccgacatgaacggccgtctcccaaagagccggcagatgttcctgcacataggcgtcgttttccagatcgtcgaacgtggtgagggcgccgattttcacaaggccctcctcctcttttatgtagcgcagctcggacaatttatcaattgcgatcacatgcgcgggcgtcttatggcgctcgtttaactcaatgatcacgtcggtgccgcccgcaaccacggcgcagctggactgatactgttccagcatggccacggcctcgtccactgtagtgggggcgtggtaagtaaagggcttcatttgtttaaactcctttcgtcctgataggctgtacagggcttatttaccgctcccgcgcactttggcgccggtcaaatcctcccagaccttgacgacggaggacatatcctcgcggccctgccccttagcgcgggccatctcatagacctggacggcagcggcggtcatgggcagaggcacacgctcgtcgcgcgacgcctcaagcgccagtcccaaatccttatactgcaaatccacggcaaagccgcctgtaaactgatcggccatgatgaatttctccagcttggcgtcaagcgcatagctgcgtcccgaagaaacggaaatgacttccttcattgtctccacggacagtccgcattttacgcccagagtcagcgcctcgcttaaagcggccatattgcatccaagcagaagattattgaccatcttgatggcgtcgccgccgccgacctcgcccacatgatagatgttcttgcccaaaacatccaaaacaggcttcactttttcaaaggtcgcgccgtcggctcccaccataatggtaagcgtgcctgcggccgctccggacacgccgccggaaaccggagcatcgatatatccgatccccttctcggcagcctttttcgccatcgctttcgtactgttgggcgcaacggaactcatatcgatgatgatggttcctgctttacagttttcaaatacgccgccttcggagcacatcacattctccacaatcttggcattgggcaaagagcagatgataacgtccgccttgcctgccagttcgcccgctgtggcgcagcccctggcgcctttgctctccatctccttgacggcggcttccaccacatcgaaggcatatacctcatatccagcgtttaacaggttgcaggccatgggcttgcccatcgcgccaagtcccacgaatccgatcttcataaaatctacacacctttactacattaattgtcagatcgggccgttgggaataaaggccgctctgggtctgtcggcccatcccagacctccattctcaacggcccgcacaccgcgggtcattgccgcttaggaaaaggggcctccggccagcgcatcgaaacgttcggtcggaggccctttacggttctattagtgcataccgtcctcgcacttggcttcggatttctgcaaaccgccaatgcggccggcgccgttcacagtcgcatgaggacggccgccgtcggacagtacaacagccatgataatttcatcggccttcggagcgtcggggacgcggacctcgaaggagccatagtgcgtgcgcacaaaagcggcgtccttgtaatgcagggaaatatcgagcgaggcgccgacaccggccaccttctcattggaggggatgatggatttgccgccgccgatggccgcgcggatgggcttgccggcctttggatgcagcatcgcagaggaatgctccagctcgccgtctgtgccgacaaggcagcccttgccgtaggtttccacagcgtcggcgcccagcagttccgcgcccttgcgcgccagcagatcgccgagatactcgccgtattcggtcagctcgcttagatcctcctgccatttgccggcatacggatttttgatgacagccgcgacggaaacagtcttgatcgacttcttgccgccgttctcgatgggcatatcagcgccgccctcgtagaacacttcttccagatttgtcacgatcttgcgaatcttcggctctttcacaatgaaacactccttcggtaaagttttataatttcaggattcttccagtatccgattgggatcaaacacagccgtgcgcccctgtacagtagcgatacaggcaaggagattccctttgccgaattgaagctttgcttccttcatcacctggtcaagggcctgctccttttccgcctcggtcaaggggtctacacccaccacgacctgctggtctgcgatgtcgctgtcgctgtcaagctcccccgccaaaactgtatgaacggccggcaggtcgagacaggaacgatccgccaacagagtcgccagcgcgtccgcctcggcgcagcgtgccgaaaataccgtcacgccgctggcaatcccggtcgtcaggcttcggccgcccaagccgctggtcgccacgccgcccacgccgctgcggtttgtcaggcaaaccgtcctggaaactgttcccgccgccagatcgtagacgacgcccagctttaaattctgcccgtcggccagacggacggcgatatctccgccgttattggcgacggccttttccgcgccatgagctgccagatggtcggccaccgcgtcggaaaccgatccggccaccgccgccatgggcgtcaaaagctggtcgcctgtagcgacgaccgcccgggccatgaccgcaggcagaccgcagagcgcatcaggatcaacgctttcaggataactgcgcagtacctccagcacggggcgcatttgtttgagacagccgtcgatgatttcaaaggcgctgcggcacaagtccgtatccccaaccccgccccgcatggcggaaaccaccatggaaacggggccataatcaaagaacacatgcccgggtgcgagcacctccatgacctcgtccttcatacggcttatacgcccagctccctgcgcagctcctccacaggacggatgcagtccatatggccgccgatcgcctcataatcggcctttgtcatggtgtattccacaggggccactgtggccggcgtaggcacccaggtaaagccgtggttgacgaccttgcccgcatcgacaataaagttgataccgccgccgggcaggatataagcaggcgcgccgccgatggtgaggaccgccttgccctcgtgaacggccttggtgatggccagcggctttgtgcacacgccgccgcgggcgctgccgcccgtgccgccggtatacatgacgctggcaagggactcctcgcagttgttcataatgtcatcggccaaggcggcggccttctctgtcatcgggatttccttcacatcgccgtccgggaggacttcgaacagggcgcggatttcgccggtcgtgttgaccaccaggatttgcatcccggccctggcgcgggtcatatccacgctcttgattgcgtcgcgcggcgtttcgatcgtggtgccgccaatcccctctccatgctcgccgaaatagcggccgcgggaggatttgcgggcgttcggtattacgccggaccactccataccgacgtccgcgccggccagatgctcagtgaaaagcccggtgacatgatggtcgatgacgatgacctcgtccaccgcctccttcatcttcttagcgaacagccccacggtggcgctgccgcagccgatgcgcatttttgcttccttcacgccgttaatgacagggggcttgccggcctgaacaacgatttttgttttcttgttgacggaaagctccacttcctcgccattggccagctccacgatggtacgtgccacgatgaagccgtccggcccggtgagcttatttgcgccgcccacggcgatcatcttcgagccgtattcctcggtgttcaccatgccgaccaccttcccgtcacgataaacgggatcgccttcctcgccgatgtaggtgttggtgtccagctttacggtgacgccggaataactcagaggcgcctcggtcacggttgtgaccacctccacgccgtcccggacttcggaaacgatatgcggcgcagggcggatgcagggatagttggtgccggcgcccacggcagtgatgatcgggccttggagccgggggtccggatatgtaataccgtcgttatgtaccaccagcgcgcggttgcgcaccagcttgccgttttcatttgtgtaccgcttgcaggcgccggtgtgccccgcagggatgcggcactgcaccgaacaagaggaacaaacgatcaagccgtccgacacgtccgacggtttgctgatggccccgaatttgcaaacgcgggtgcacacgccgcattcacagcacttttcggcactgacgacggctttgcgctccaccatttcgattgcacccaccgggcagttctttgaacagatggtgcagcccttacatttttcatttacgattaccattgagcgtctcccactttctcatcagatcgctttggggctgttgtcagtcccgcttcagatcactttcgcagcgcgtttgcaaggaggcgtattgcggctcttggcggccttgataacgccgtcgaccataatgatgctcaggcccggaatgtcgccgcattcgaacgcctcgacagcagtattcgccacagaacccatcggagcgtccatgaataccaggtcagcctcgcggcccacggcgatgataccggtattgagcttgttataaaccttggcggagttgccggtcgccatgcacagggcaatctcgccggggatgtcggaaacggaagcgacctgacagatgttgcgcaggatgcccagcgggataatgccggtgccggaaggcgcgtcgtttccgaaaataatacggccgagctggcccttctctttggcgcggcgggcaacgtagtcggtgactttcgggttgccgcactgaacgatctccatcgcgaaatccgtttcatccatgagcttatcaacctcactgagcggaatcgcggtcgggccgccgttaatatgggaaataacatccggctttgtggccataacctgggccgcggtgacggtggaggaaccggggatcgaggtgccgcctgtgtgcatctgcaccttcatgccgttcttgtgcgcccactctaccatcggcgccgcgtcggcgggatccttcacgctgccgagtccgatttcaccgactgtccagacgccttccttcgccatctcctcgaagtccttttctaccaagcccttttcaagtatgacgctgccgccatgaacctttacgccgccgggcttgagcgccgcgaacgacttatgcgccaggatggccagcgccttggtgcccgcgggatccttgggacggccgggcgtatgacactcgccggcggaaatgatcgtggtgacgccgccgtgcagctcgccttcgatgaaattgctggcaaactgacgatgcgcgtagtcgcccagactggtatgtacatgtgtatcaaacaaccctggcgtaacggtagaaccagccgcgtcgataaccttctcagcctcgataccgttcgcgatctccgcgccgccgatggctgcaattttgccgtcggtgacaacaattgtgtcgccctttaaaataggattgtcgatatcaccgctgagaatggtaccgatgtttttgatgacgatggaactcatagcaaaaacccctttctgtttttatccggtctgtaacttatttgtatcccttgcggggagatcggtcataacggaatgtggcgggcgcctgttaaaaaacaggcgcccggctcgtaacatatgtatgccgccgtccgggatgcggcgctttcatcagacgagtttgtaatcgccctcctgaatccagccttttttccgcataaattcggagatgacaaacgccagaatggcgggaagcacgaaacagatcaaaagcattccaatccattccatagcgccgggcgtgatggccgtcatacctgcattaattgcattctcgctcggcgtcagccatccggtgacaacgccgatcggtccaaccagaccggcggtacccatgccggaagaaatcggagcgccgttcatggtcaagccgaacacacaggtcgcaatcggcccggtgatcgcggctgcaagcgtcggaggcagccacagaatcggctttttaagcaggttggggaccagcagcatggaagtacccaagccgatcgcagtcaaaccgcccaatttgttttcacgataggtgcagaccgcaaagccaaccatttgggcacaacagccagcgacagccgcgcctcccgcaagcccgacaagtccgagcgccgcacagacggcagccgagctgatcggaagcgtaaggacaatacccatgataacagacaccaaaatacccataataaacggctgctgattggttgcccacataatgatatcgcccaaaataactgcgatttcgccaatcggcggtgccaagaatgttgcaagcagtacgcccacaacgatggtgactgtgggggtaacaatcaagtcaatcggtgtgcgcttggaaaccagcttgccgcagaagatggccgccaggctgataacatagacggccagcggtccgccgccgccgcccagagcattcgccgcataaccgacagtcgccaaggaatagagcacatacgggggacagcccattgcgtaaccaatagccagagccatggccgcaccctgaaccgctgcggtatatccggagatttccaaaagaaaagcgccgacgcttcctgggataaaaccgccgatggtcttgatgatggtaccgatcagcagcgacgcaaacaaaccatgagccatgccgcctaatccctgaatggcaatacgattaaaggaaagctcgatgttttgttccttgaaatactttttgatgccggttagttcctgtgcgttgttttccatttgcatagatttcctcctcctcgattcgtaagctgtgtctggcgcgcaatgcattgggaatatttcccgaccgttcccccgtcggccggttatctataccacacgccgaaaccgacatatggtatattcaactttatcattgattttcatcttaattatattataataatatcgtatgatttttttgatcatttttgtgtttatttcaaattattgtagttaattatcacaataaattaattgaaacgtagcaaaattgcagcaaattatttttttaacatatatataataccacattgggcatatgatttcaaatacaataaagttttgcaaaacgcctcattatacattttttatatattgatatactcaataatatcaaaaatattaaagctctttttgtgcaatgacaccaatattaaaaactatggaggagtttttgtgcgatgacactaaaacagctggagtactttttggagatcgcgcgactgggcaatgtcacccgtgccgcccaaagcctgaatatttctcaaccgccgctcagccttcagctcaaatcgctggaggacgagcttggaactccccttttccggcgtgacaaacggcatctggagatcacccccgccggcaagctgctccaggaacgcgcccaggcgatcctggcccttctggatgaaaccaccggtgatatccatgccctgtcaaccgaaaagcagatcaccctgcgcatcgccaccatcggttcggtaaacaaccgcctgcttcccaatctcatcgcccgtttttcccgggattatttctatgtcaattttcgtgttatcgaagggaggaccgagcatgtcctggagcatgtaacatccggtgatgtagatttcggcttcgtccgcgaaccctttaacacgtcccattttcgttcggtcttgattcacgatccggccttagcgccaggtcagtccgaccatttcgtcaccattgcacagccccaattttatgacgcctattatgaaggcgactcccgcgacaccatcgagattgacgagcttaaggataagcctctgattattcatcaacgttaccgggagatgatccttggagcctgccgcaagcgcggcttcaatccctatatcatctgcgaaaacgacgaaatccattcctccctgagttgggcacgggcgggaatcggcatcgccattgcgccgtacacctcagccatcctcagcatcgatccgggactagtgatccgccgtctgacctttacagccttcattccctgggtacgtctggtatggaatccgtcctgccagctttccagcgaggctcttgcttttatgaatatgatttgatcaatgctctcactccggccaagcttataaattttagctgcttttgaataaagccgcccgtgcagtcaagaattctttcaacgaacagttgggaggattatccatgaaacgttttcatacaacacggttcgattgtgccgttttgctcggcatcgttttttctgtcatgctcgccaatctctccgtgtttggtcgggaatgtgcacaggtacgcggcgatgttgtccgtttacatatccttgccaattccgacagcggctatgatcaaggtctcaagctgcgcgtgcgcgaccggattcttgcacaggtcggggggattttcagcgcgcagcaatcgcaggccgacgccaaagcggcagcggttgccagtctaccggaaatcgaagcggccgcgcgcgccgcgcttattgaagctggctgtgaagcgccggtgcgcgctgaggtttgcagcatgtatttcacaacgcggcagtacgacgatctgtccctgccggcaggcatttatgacgccgtgcgcgtgaccatcggcacgggcgccggacataattggtggtgcgtcatgtacccgcctatctgtctgccggcggccgagcctcctgaatcggccgcactcactgaaattgaagcgttaaacagcgaacctcttttcaaaccaaagctcgccgttgttgaattgcttgaacgtttttttccatcgaagtccatctccgaaagcgccatataatcaaaaaccggccatccgggcattttcagcccggatggccgattcctttatccagtaaattcccaacccactgatgagcattttatgcgcaaccgcttctttgaaagctcgatatgcttaccccaacactcacgccactaaaccggaaggtggttccaaatgtccctcagccggcttaggcggcaccgccgggcctaaacccggttcaggcttcgccgctttgggaccatcggcgggaccggaggacttcgccgccgggcctaagcccggttcaggcttctccgctttggggccatcggcgggaccggaaggcttcgccgccgggcctaaatccggtttaggcttcgccgcttttgggccatctgcggaaccggagggcttcgccgccgggcctaagtccagctcggcagaatccgccgcaaatctgtcgttcagttcatctggaacagccgcagaaatgctgccattcggtccgcctgttgcagccacgccgctgtaggcatccgggccttgatccggcaggttttgattagattccgccaccggcaaaaaggcagaaacactatttaaatgagggggcagagggcgtctgataaaagcggcgtaaagaagccctattataatagctgaaacaatgaatccaccgattgcaatatggctttttttcacatacattttatcatcacctttttccaagacctgatttacatgttagatttccgttgattggtaattaaactttctccacaatctgctttgtgtcgcgcgcaatcaaaagctcctcattcgtcggaatcacccaggtctccacgcggctgtgcggcgcagaaatattctgctcacgtccctgtgactccctgttgatgacctcgtcaatatttagccccagaaaagccattcccgcgcagacgcgcttgcggacatggtggtcattttcaccgatgccgcctgtaaagacaacggcgtcgatcccacccatcgcggcggcatagctgcccacgaattttttgatctgatacgaaagcatatcgaccgtcaactgcgcgcggggatcgcccttgtcagcggcgcgggtgacatcgcggttgtcgctggaaatgccggacaggccgagcagaccggattttttgttgagcatatcgctcatttccttcatggacaggccttccttgtcagccagataggtgacaatcgaagcgtcgatgctgccggaacgcgtccccatgatgaagccgtcgagtggtgtaaagcccatgctcgtgtcgatacagatcccatttttgatcgcgcacagagatcctccgttgcccagatggcaggtgataacgcggcttccggtgcggctgatatcggaaatttcaaagagacggccgctgacataccggtgactcgtcccgtggaacccatagcggcgcacatggtatttctcataatactcatagggaatgccaaacatatacgccttttccggcatcgtctgatggaacgccgtatcgaataccgcaacctgcggcacatgctcaccaaacaccttgcggcaggcctcgatcgaaaggacggcggctggattatgcagcggcgcaagctcgcacaggctctcgattttgccgagcacatcgtcggtgatcaaaacagattctgtaaaatattcgccgccgtgaacgacacgctgtccgattgcgccgatttcaccgatgttttccagcgcgcgtccctctccctcgatcagatgccggaccagctcgcgcagcgcctccgtatgtgtcggaaatgcgatttcgctggtgtgcttgacgccgtccgggccggtatgcgaaattgcgccatcgatgccgatgcgttcacaattgcccttagcgagcaccttttcgccgtccatatcgatcaactgatactttaaggacgagcttcccgcgttgataaccagtaccttcatgcatgtaactccttttctttgttcacgcgcccgtttctccgtcaaattggacaggccgttctttttctcttttttacagtgcaaacttgacagacttctatacagttatatattattacaatatcacacaaattacaagcatggattttatatggttttgttaaaaaactatcattgttccacgctatggaaaggtccgattgtatggaaaaaatggtggctgcgggcattgtcgctgaatacaatcccttccacaatgggcacgcctatcagatcgaaacgacccgtgcagccggcgcgacgcatattgtagccgtactcagcggcaactttgttcaacgcgggggtcctgcgtgcgcgcccaaatctgtccgcgccaatgcggcgatcgcctgcggcgcggaccttgtgctcgaactgcccttgccctacgcgatggctacggccgaacggttcgccgccggcgctgtgggcctgctcggcgcgcttggctgcgtggatgtcatctcctttggaagcgaatgcggcgatctcgcattgttggccaaagcagccgaagcaatctgctccccctactgcagcgattatacgaaaaacctgctcgagagcggcgtcacctacgcgcgcgcccgacagaaggcggtggaacaactttacgggcagcagatcgccgaggttttgtcctccccaaacaacacgctggctgtggagtacctgcgccagatcgccctgcaaaaactgcgcatcgcgccgttcacagtgacgcgcggcggcgcgcgccacgacagcggcaaagcggatggaaaaacggcctccgccgcactgctgcgcaatctgctcgatctggagggcattgaatcgatcgctccgtatgtccctgcgcccgccctgcaaatctaccgggccgcggcggccgccggacggatgccgtttgattcgcacagcctcaataccgctgtgctcgcccacctgcgcatgatggaaaaggacgctttttcccgcctgccggacatttcgagcgaagggcttgacaaccgcctccatgatgctgtgcgctcgtccgtctcgctcgacgatcttctcgcgcgaaccaaaacaaaacgctatacgctcgcgcgcataaggcggcttgtctggcacgcgtttctgggcacggacgcggcgctcatgcgtttgccgccgccgtatatccgcgtgctcgcctttaaccgccgcggcatggagctgctttccgccgccgatcaaacggccagtcttccaatctcgcattcgctcgcaaagctggaggcgcacgacgacgtctgcgcacgctttgcacagctcgaagcgcgcgcggcagatctctatgcgctcgggctgcccggcgtgctgccgtgcggctctgattacacacagaaaatatctgtgcacggataaccgcttgcaggacgaatatatccgtggtatactgatcatatggcagatattgcctgtacaggcccttacggatgaatttggaggtgcttttatgccaatggatccgatcacaattcgttcaagcagcaacagcaatctggagatcaacgcaattcccggccattttgtaaccagccattcacacatcaactattatatcgatatcactgcgatgaagcatgatttcaccatggcgcgtgaagccgcggaaacgctggctggacgcttctcgtatgaaaagcccgtcgatacgatcatctgtatggatgggaccgaggtcatcggcgcattcttggcccaggcgctcgcaaaaagcagcgcctacactgtgaacagccagaaaaatatctatgtcgtgccgcctgaattcagcacaaatggacagattattttccgcgacaatctggagccgatgattgccggtcaccatgtcctgctgctgcttgcttccgtcacaaccggcaaaacgatccaccgcgcgctcgaatgcatcgcctactataagggttacaccgaagggatcgcggccatattcagcgcgtgtgacgagatcgagggccatacgattcaccatctgttctcctgtgccaacatccccgattatacgacctgctcgttccgcgactgcaagatgtgtcacgacggcgtccccatcgatgcgcttgcaaacagctttggattttcgactctccgataaacacggctgttcctaagcaaaaaggctcccgcccaatggcacacgcccataaggaagtaatttaatcatgttgcagggcggcatagtcaaaggctatgccgttctgctttttctctgcctttcaaccgtttgcttgtcctcgtcctgttccagttccccgataaagttccagacaatttcaatcttctgtctgcggtgtccactggatttgtctggcgcgtggacaataattttctttacaaactcattgacgatagtaggcgttaattcccgtattcccacatacttgcggataacggcagcaaagctgtcaaaatccgttctgtcctgttcgtaagtatcaacggcagcttgctctaacttgacaaactctgtcagttccttttgctccgcttcatactctgcggacaacttcaagaatctttcgtggctgattgtgccgttaatatcgtcctcgtaaatccgcttgaaaatacggtcaagctcggcaatccgtttccttgcctgttcgagttctttcttttgccactttactgccttttccgcttcctcaaacctctgctgataaaccatgttttgaaagctctgtatatcatcaaagaacatagccgttacatcaaatatcctttgcaggacgaacagctttaaggtttcttctcggataaaatgcgcggaacaagtacctgtattgctcttgtagttggagcagacataatgctcttgtttgggcgtaaaactgtttgttgtgcaaaagtacagcttttcgccacagtcagcgcaataaagcaagccggagaataagccttgccgtcctgtctttgtagggcggcgtttgtttgcccttaattcctgcaccctctcaaatacctgttcctcgataatcgcaggttgcgtgttggggaagatacggtaattttccggcgcattttgcagacgttttttcagcttgtgggatttggaatacgttttgaaattgactgtacaccctgtatattctgggcgttccaatatccccgctatggatttgtaatcccaacgatagagattatccggcatagcctttccgtcacgctttgcatagtaggctttgactgtcaacactttgtccgctgtcagcgcttttgctatctgcatgggtccttttccagcaatacacaaatcaaaaattttctttaccaccgcggcagcttcttcatctacaatccatttctttttgtcgtctgggtatttcctgtacccatagggcggattggtacaaagatgttctccggcattgccctttgaccgcatgactgtgcggattttcttgcttgtatcgcgtgcgtaaaaatcattgaacagattacggaaaggggtaaattcattatcgcctttttcactgtctactccgtcattgattgcgatatagcgaatatcacgctcggcaaagaaactttcagtgtagtagccgactttcagataatcgcgccccatgcgggacatatccttgacgataaccgtcttgacctttcctgcttccgaaagccttatcatttcattccaaccggggcggtcaaacgttacaccggaaacgccgtcatcaatgaaaaatgtaggattaggaaaaccgttgtcctttgcatacttcaaaagaattttcttttgattggctatgctgttgctctctccgtctaaagcgtcctcttgagaaagccttgcatataaagcggtaatgttgtcgggatagtttttcgtcgttgtcatgtgttcattcctcctgtaatgaacgcccgacaaacaggttgctatcttcattatagcggacttctttttctttgtcagtaggcgttttgccggattccgcttttatgagcctttccattttgctataaagcggttcagagccaccgcaaatcgttgacacctcaaaaattgtgccgccgattttgtaagtaactgtttcatgcagaggattgcccttttgtggcataaatccgttgttttcaatatctcgtttcttttccattcctttcccgtcctttcgtagtttgatagaagaaaagtttctcagcaagcataggaacggggtaccctttccgtaaaatcgtccgttttctgtctgccgacagcgggcgatttttgcttgttgggaagtttcccaaaccctctcaatttttctttcactacctactacaccggacagggcgattttgccaaagattttgaaaaaaattttttgaattacttactacggagaacagattaaaaatatcaaagagcgcaaaaaaatcacgcgaaaaaatcaagattgatataggattaagaatgtgctaaactgtatttgccttagattatcgtgtcagacagaaagaagtgattttatatgtgtattaacacccaaaagagaaacaaagcttttctccatgcaaagccagtagattgcgacggttgcatggagtaaaaaatagtcgcaaaataaaaatgctggctttgcaacttgactatcacatcaaggaggaagcccgcatgaaatatcttaatgcacaagttattcttccggaagcattggtaaaagagttgcaaacttatgttcaaggcggatatatctacgttcctatcgaacaggaacagcaaaaacgttggggagaagtttctggctatcgtcaagaattagcacaacgcaatcagcggataaaagaggaatattaaagtggtatttctatggagtgtctgtctgaaaaatattgtttgtctttatatgctgttcggaaaatcatatatcaaaagtaaccgtaaggggctgccaagcgcagcctcttattttataccaatcatttcggtatcgtacagtatatagaatgtccatctgaacggctgtaaaataaaaacgaagcatacaaagattttatgaaaggcggctactatgtgtaccagattcgtttatcgcggaagcgacataataacaggctttaattttgacattgacctttctgtatggacgcataaagtaataaaagaaaaagggcgtttctatattggaattttgcgaccggacggaatttatcattcttatcatggggtaaatcaaaacggaaatgcaggaacgctgttatatgtgcatggcaattctgccggagcttatcaaagcggcagtaactgtatgacgattgccgatttgacagagcagtttatcaaggctcagatttcctttgatgaggttcttcaaattgctaaatcaaagaaaattgtttatgcgccggacgctaccatgcaagcaatgttgtctgatgtgcatggacgcactttagtaattgaaccgggaattggttacagggaagaacagagtaagtattccttaataacgaattattctttgatgaagccagaaagtacgagagattttattgtgtcgggtgacgacagatatgaacgggctttgcagttattagataactgtaaaaatgaattttcagttcccgacgcatttacattacttcatgctgttcgccaagtgggcatatgggcgaccagagtttcatttgtttactccgtaaacgaacatacagtgtactatgcggaaaataatcgctttgagcatatcagaaaattcatttttccgtttgcctaataagaaaggagcagttatgccacagaaagtttatccacgttcaaaggacaaagaaacagtctatttaaaaagtgttatcagcaatcccaatatcataattggtgattacacaatgtataacgattttgtcagaaagccaaaggattttgagaagaataacgttttataccagtacccaatcaaccaggataagttgataattggtaagttttgttcgattgcctgcggagcaaaattcatattcaatagtgcaaatcacagcttatcttcgctttctacctatccattccccatattttttgaagaatggaatttagatgtaaaggatattacaaaagcgtgggataacaaaggcaatattattatcggaaatgatgtttggattggttatgaagcagttattttagcaggggttacgattggggacggtgctgttatcggaacctgcgccgttgttactaaagacgttcccccatatacaatcgtcggcggtgttccggcaaagcctataagaaaacgatttacccaagaaacgattgattttctgcttaaaataaagtggtggaattggtcagaagaacgtatcagacagcatataaccgatatacagtcaggaaatattgaacatttgcgttaaagtgccgcacgacggcaaaagaaaaaaagccgtcgtacagcataattcctcatgcacaaaaatctttcatggacggctttgaaatatggagccgcccatttctattatgtcagcaaaaatgtccatggcggtattaaggaggtatcgccatgattctatcggttaataggcaattattaaaaaaatcccgttttatacaacagagtattccacccaagagtatgaactgtctgctcatttagtatgtcataataactcatgttcttcaaacgttcatgcggtcttattctgcgtgggcgtttgttgtaatatcccccctactgggaagaaagggggtgatgagaaaatgagatattctgaacaatttatggagcatatcgaatacgcttttgccgccttttgcagaatcgttctccgtaatgccgcgctcaacgcataccatgattttaggcaaaagaagaaacgggaagtatcgcttgactatctgatgtccaaaacgtcttttgaaccatttacaacggataattattttgagcagtacaagccgacaacctttgttgtgaaaggtcaaaaagttactgttgttagcgagcgattagccgacgcattatccaaattgtcggaacagcgtcgtactgtcctgttgatgtatttctttctgggctatactgatacagaagtcgggaaagagtacggacggagcagaagcacagctaactactggaaattatcggctttaaagaatttaagaaaggaactggagaaaacgaactatgaggaataagaagcatatcccctttgaagtcattgaaaaagcggttgccggggagccgaaagcgatagacgcagtattacggcattacaacggatacatcaaatatctgtctacttatcaaggacatatcaacgacgatattcaagaccgtctgaaagcacagcttatcaaagctatcctgcaatttcgttttgacaggtagggagtagcagagccagaaaaagccgtcaaggataaaatgcacgcttgcacgtccttgacggctttccctgtctttgctgttgggcggctaagagagcgcaatcggataaaccgcttacgctctcaatccattatggaatgttacgcagtagaggttgatttccccttgatttatgcggtttgcaaggtgcattcataggggaataagggatttatactcataccctcaaatggcggctctactgcgtaacggatataaaaaataggtatagtgggttaatcattgatacaatccttgtatattccaaggcattaaaatccattttccattatttctccaaggaactgcaatatgctcagtaatgctttcataaacacaaccaaaagttaaaatagcttcttttttacaattattggttgtccataatactttgacttctactttagataatgcacaagcacgttcttcaatttcaataatttcaaaagtatcaaatattttgttttcaaacaatttcctgcattcaccagctttttttccagctgataagtttgtcggaaataatttttgtaaatgtattgacaattttccgtagtttttattcttccacgcagataacatttcaataacttcagcaatgtacggatattcagtataatcccctgctgttccagaaggcggaatatctttgcctacaataactgttcgttttttccacgaagaaatttcatctcgaatttgtttgttttcctttaagcacgctaaggattctcttatagggggtggattaaccgacttttcatacttctcttttcttgtttcttcgctattcttcattttcatccaatcggctacagcaaacataagggatacacatttacatgatacatattcatttgcgtaattcaagtcgcgaccatgtaaaattccattccgatagggaagcgtaattacttctgtatttgtttttgtgcgtttttggttaaatatgccctttaactttgttaatccatcactacatcctaccaagcaatcccatgcgtcaatagatgtaccttctgcaaaaaaacctttgcttttggtaaaatcatttactgcaccatctactataatcaacccaagtgggacacttgcataataacgttctgcaaaatggtcttcaaaaaaacgttgtattaaattatctcttacagcaaatgcttctgaactatgttttatccaatgaatggttttactcacatctgatttatagtaattgattaaaatctgttctgctgcttctaatccatttgtttcaaattctgcatttgcactttccataagggaaaaattcatactatcatatgcacaccaaccttgagaggaaaatctatcattaaaagcagttgtttgaacaatcatattctcaagttgcttttccatatcttttaactgtttcctctgttcgggttttaagaaaattgatataagtttcattgcttttatatcagtctgtaatttatttagtgaaataagattattgtccattttaattccaccacccttataagtttatcttatcataacataaaacaactccgaatgctattaacattcggagttgttgcaccctgtttgtcagccgttaagattagtttgtttccaaaacttccttatcggcattcagctaagggcgggagcctttttgccgctgcacggcggacgttccagaggtctgtttgaaaatagaggaattaccgaattttcaaacaccccctggtttccaagcagcctcaaccgcccgcttcgaagctgcggcgtgtatatgcatactttgcaactaaaaatgaaacagccaacgccgcaaatcccgctgcccaaagggccggtccggcgccgcgaggcaatcgccacgaatcgccgcttttggcgatcccacggccgaaaagcgtcgcaccaagaaataaagcgcagaacagcgccagaaaccacttctgcgcgcgtattgcgccaagcgtatacaaaagcgccagcatcacggccgccagtaacgcccccgcaaaaaaaccgacagccatgccggcgtctgtcccaagccggttcaaggcacgcggcagcagcggtgcggcggctccgttgacaagccgcatgatcgcacacaaagccaacagggacgcgccggtgaacagatagcgcgcgcagacagcctgcgcgcgcgttaccggcagcatgcagacagcggcgctcaccgcgccgtcgtccgcagccgcggtgcaggaaatcacccaagcgcccatcaaaaaaccgatgaccgccagaacgtctgacattgaaaagagcgccgtctcaatcaggactgccgccgcgcttacaggcgcagcgcaaaggctgcgcaggtcgagcgccagcagccgtgcgatattccgcatctgaatccctcctgccaagctgtaaaactctcccgcttttcagaattccccgctatgccataatctcctttcggctgtaaagcgcctgtgctgcaaaataggagatcagcagcaagccggcccccgccgcagcgggcgctccagtgagcgtcacaccggatgcgtgcgtgttcagcagctcgccggcgataccggagagcgcgaaggccactacatacatcagcagaattgcgtatcgcgcctttaacgcgccaaagtacaggatcagcggttgcgtaacggagacgaacaccgcgcccatcaaaaacagcagcgaaactgattgcattgcgtctgttttggacagcgctgcaccgatcaggcagattgccgcgagcgccagcaggtcatataaatagcaggcgcgcacgatttggcgccgcgtgagcggcagcgcgtgcagcagataagcgccgtggctttggtcgtcatatgccggtaccatgtagatcagcagatatagaaatacgacaaacactgccgaaatacccgacgtatatccgatcacgcagacgagcgcagccacaatcagaatcatttccgtcccacaattgaacagctttaaaaggttcattctgataaccgccagaatatcagacatgatgcgcagcccctttccctcgtgtatacgccataaacaaatcctcaatggttggtttttcataaacggcttcattaccgaacagagcgaatgctgcggcttcatcctcacataagccccgaaaaccaaaatctgattcctcaacgccgcgcaaaagtgcgcgcgcctgctgcgtcaacagctcacggcgtcccttgaccatgcgccgcgtatcgatcaaacgatccttttccccctccagcagcagttcgccgccatgcaaaaaaatcagatagtcggcaatcttatcaagatcggaagtgatatgcgttgaaaagaacacgcttaccccctcctgttccatctcctccgcaagcagatccagcacctcctgccgcaccaaagggtcgaggttggccgtcggttcgtccattaacagcagttttggccggcggcacagcgcaacagccagcgcaaactgcttctgcttacccttggacagagatttaaacttttgctccggcttcaatccgaaccgctccatgtaccgcataagcgccgtatcgtcccactggggataaaacggccgcatcatcgaagcaagcgcccgcaggcgcgcgtttgccagaaatcccgtttcctctccgacataaccgatttcgcgccgaaccgcctcgccgtcagcgcgcgcatccagcccgaatactctgactgtccccttatcaggacgcagcatatccatcagcagcttgatcgtggttgtttttccagccccgttttccccaacaaagccggtgatatatccctcccgtacacaaagcgatggcagggaaagctgaaaaccgcttttatggaaacgtttttccaggcctgctatttctattacattgccgttcatggctgttcctcctcataaagcgttttcgtgatctcccaaagctcctgcgctgttaaaccaatcgcacgcgccgcatcgacagcttcgcttaatcgctgctcgatctgacttaatgcaacctcgcgcagacggtcgcggctggccagggaaacaaatgtccccttgcccggcgtcgtcgaaagaaatccctgcgcctccagatcgtcatatgcgcgtttggtcgtaatcacactgactttcagctcccgtgccaaatgccggatagagggcatcggcgctccctgaccgagccggccggcaaggatttcgtttttgatctgttcctcgatctgctcatacagcggacgcggcgaggagtttgaaatgataatatccagatgatcgcctcctccgttattatctgtatatttattatatatacagataatatcattgtcaagcggcttttattagaaaattatgtttatttgcccggcagccaattaccctaaaaactccatagagcgtgttgacataagttgaaattgacacattttgagcagaatttttgtcctgccaggcaaacattcgttacaatccctggtgaatgcagaaatcattaacgacgtaaggcggaaatttttccaaaaggtagtggtttcacactcgtgtcgaaatgttctaagctgtaggcgcaccgcgtataaaattttacagttttttttttacttttgcgcagcaaaaaaagaagcacaggcccgcctgtgcttcttcacaaatccattctgtctttataaatccatgcttcgcgacgcgtgctccggcagcggcgtgctgttgacaatattgtcaagcagggcgctttgttcctcataattaccgacactctgcgcgtcatgattgacggtgggggaatcggcacggcgcaaaagcagatacatacgcggcagcccctccagccccaaagcgtttacaaacggcttccccgccaaggcataacggtcctgcccgatcacagcgggatcgcccggatagcgcacggataaatcctcaaaaagcgcctctccgccaatctgagaatagacgtaatcgtccactataaacagatccgatttcccatcgcggatcgttgtcagcagcgctgtcaacggcgattttccggtcagatctccggctgcggggaattcgtaaacgtcgagcgaaatcacgctttcgctttcctcctgatatccggacaactgcgatttcagcgcctcgcgctgctcaacggatacatatccgcgcacagcgaccacgaccgtattgacgccgtcgtcccgcccttcggaaaaataatacgcgagcgccagcacgaccgccacgaccaacgcaacgacgaaaatgcccatgcgccgtttatgcacaatgcgggcgtcacggttcttgctgctgtcgatggccgatcgcctcctttcgcagaaccctcctgattatcttgcttgactgccgggcaatttattcgcggacgggcttcatcgtcgggaacaaaagcacatcgcggatcgacgcgctgtttgtcagcagcatcacgagacggtcaacgccgataccgagtccgccggtcggcggcataccgtactcgagcgccgtcagaaagtcctcgtcgatatcgttggcctcatcgtcgcccgcagccttgagcgcggcctgatgctcaaagcggccgcgctgatcgattgggtcgttcagttcgctgaacgcgttcgcgtgctcacgcccaaggataaacaattcgaaccgctccgtatactccggctcctccggcttacgtttggacagcggcgagatatcgactggatgatcggtgataaaaacaggctggatcagatgcttctcacaatactcctcaaagaacaggctgagaatatcgccctttccatggcgctgttcatattcaatgtgatgttcctttgcaatggcacgcgcctgttccagcgtctcaatctgtgcgaagtcaacgccgctgtattttttaaccgcctcacgcatcgaaagacgctcaaacggtttatccaagtcaatttccacatcgccgtacacaattttgcccgtaccgagcaccgcatgggcacagtgacgcaccaaaccctctgtaatatccatcatgccgtggtaatcggtgtacgcctcatacagctcaagcagcgtaaattcaggattgtggcgcgtatcaatgccctcgttgcggaaaacgcggccgatttcatataccttatcaaagccgccgacaatcagccgcttgaggtgcagctccagcgcaatgcgcatatacatatcgatatcaagcgcgttgtgatgcgtgataaacgggcgggccgccgcgcctccggcaatcgcatgcagcaccggcgtttccacctcgatgtagccttttgcttctagaaagctgcggatcgccgtgatgatctttgatctttttacaaacgtatccttaacctcaggattcacgatcaaatcgacataccgttgtctatagcgcaattccgtatcctttaagccatgccatttctccggcagaggcagcagtgattttgacagcaatgtgatttcatgcgccttaatggaaatctcgcccttctgggtacggaatacttcgccgcggataccgacaatatcgccgatatcccattttttaaaatcagcatatggttcgtcgccgatttcatcgcgccggacatagctctggatacgaccggatgcgtcgcgcacatcgataaacgacgccttgcccataatgcgccggctcatcatgcgccccgcgatcgacacttccctgccctcataatcgtcaaatgcatcgacaattggctgtgcatatgccgtgcgcgtataagaggttgtcagaaacgggtccttcccctcgtttttcagtgcttcaagcttgtcacggcggatttggagcacttcggacagcttctgctgttcctcctctgcggtcagctctgccccggtctgattttgattttcctgcatgatctaacacatccttcttgttgccgggcggcgccgcgcccaatctgtccctatgaaccatgtccgcgaagcggcatggtataatcggccgtcagggcggcagcggaccgcgcccgcgtatcgccccggccatgaggtgtataataaccgctttgcggttattataccaaaaaaaacgcaccctgcatagtccctgtgctcccatctgtccatatcccggacgacggcgcaagccattgcctccatggtatagaaaaaaagggggaacgccccccttttccaaatcccaatgtatcggaagcttcagcagtttttaaaggccgatctcaagaatcttcagcttcaacaccgcggcgggggcatgaatctctacaacatcgcccaccttatgcccgatcaggcccttaccgacaggcgactcgtcggaaatagactccagatcattatgcgattccaccgagctggcaatcgtatacaccatttcttcatcatagtccatatccaagattttgacacgactgccaacggaaacaacatccgtcgagatttggtcgcgttcaatgatcttgacatgcttgagctggtcttccagcttcttgatacgcgcttcaacaacggcctgctcatttttggcctcgtcgtattcgctgttttccgagagatccccgaagccgcgtgcgacgcggatcttctccgaaatctcgccgcgcgttacgcttttaagctcgttaagctcctttttcagcgcgtcgtagccttcctgcgtcattaaaagttgtgttgccattcccacattccccttttcagaccatccacttttagggcctgctcattttcattccatgccgccttgcggcagaagccgcccgcaaggccggcaaataagaatgattcacgaaacaggcgccgattatacactgacgggcgcgtcttttccgcgcccgtcccctgcaatgactagtattatagtcaaaaggtttaataatgtcaagtggataaactataaatttatcatatctcaccagcggccgcccgtccgcttttaaagcatcatatgcagtaccggcgccaactattccgcatccataaacaggcgcggcaaatttgccgcgcctgtcgtccgcctggagtcttagggctgtcagcctgcctgcgaagatgtgtccgtctcgctggatatattctgtgcggcgctctgctctgaagaagcgtcctcagagctttcctcagaggaggcttcttcttcagggctgctttcctcctccggtatctcgtcgctttcctccgcgctggagacgctttccggcctgctgtcatccaatatatcctcatccgtgattacaaccgtcgcattcatcgcattcatcgaaacctggacggcttcgaccgcttttttcagctgcgtatcgaacgcgggatcactacccttctgtccttcttcggataagcgcacctcaaaatcaggctgcacaccctcgccgtcaaagcttgggctatagggcggattatagcgcgcagttgtaatctcaatcgcgcttccgtctgtcagaggaaatatctcctgcatggttcccttaccggctgttttaacgccgatgatctgtcccttgttataatcgcggatcgcaacagcaaacagctccgcttcaccggatgttttttcatcaacaagcacagccatcggcagatcgacagatcgctcgtccgaggaggcaagcagtgttgtttcgccgtttttatcggtggatgataccagcgggccgctcggcaaaagcttgtccagcacctgcgtcacggaataaagcgtccccgtgtcgacacctcgcacatcgaaaataaacgccagcgctccatcaccgatcatctggtcgacctgctttgtaaactgctcgggcgtaacgtcattgaactccttgattacaacaagcgcaatcgctccgtcaagcattgtgctgttgacagacggcgtttcgacaaaacgccgggtcaaatcactgatcagcgtctcctcaacgccgcgccgaaccaaaaggttcatctttgtaccggcttcgccatacagcatcgcggctgcctcccggtaattatcggccgttacatccgtatcattgatgcgtgtgatcaagtcccccgcctgaataccagctgcctgcgcgggcgaatcgggatagacctcatcgaccattatataaccgtcgtcattcatgtgggtcgctataccgatctggacatactggttgctgtaatcctgcttctgacgggcataggcggcggcgtcataataacgcgcatagatatcgccgctaccctccagatagccggcagccaaagcgtcgcgcaaggcgctttccgtgatggtcccgatataattctgacgcacataatcgtccacctcagcgagcttatcatacatcttctcacgctcgacaaggttatgtgtcttgtcgttgaagtttcgttcggccataatccaagtgatagaaaaggtcgccgccgcgatgatcgccataaaggccacggccgctccaaacgatatttttttgctcatgccatgtctcctttcatctgaaagagggccgcaacgaaccgagccggcgcggctgtccgcagccggccaaacgaaaggcggggccgcggccccgcccattcgcagaatggcccggcaacaaggccgatcagcctgtaaagctgtccggattgatcgcttgaccgtccttgcggatttcaaaatggatatgcggcccggtcgaccatcctgtagaaccaacctcgccgatcttttcgccctgagccaccgtctgtccaactgtcacactgagcgcgctcatatgggcatacagcgtctggataccgccgccgtggtcaataatgacatattttccatagccatagcccggcgtaacggcggtattggccaccttaaccgtcccggcgttcgccgccaaaaccggagagccgtaagcgccgccgccggaaatatcaattcccgtatggaaatcgctgccgccgaagcgggggccgtattcacaggtacgctggaacaacgtcgcagacggccattgcataccgccgccaatatactttgtctgcttggaggtttcgttgatttttgcaatcaatgcggagatttcagcctgcacctgcttcatctcagcgtccttttgcgctttgttagcaagatactcctgctccatcgccgccatgtcctgaatgcgcgcgttggccgtcgccatctgggcgtcaagctcgactctcttttcttcctgcaccttcttgtctgcttcaataccggccttatccgcttcaatatcggctttgatctctccaagctccttgagctgtgcgtcaagctctgcaagcagatcctggtcgtgctgggcgacgcgtgttacaacctctgttcgcgtaagcatctgagaaaaatcgtccgcgccaagcacaagcccgagcgtgcttgcctgcggctgcatgcacatcgcgcggaaccgctcctgaaacagcgcataattttcatcgatgtccttttgcttggccttcatctccgtttccttttcggcgatgcgttcctcgagcacggcaatgcgctcgtcaagcgtgtcgatctgagcgatcgtcgtattgatctgtccgtcgatctgctgcttgatcgccacctgcctctgcttttcgtcctgaacactgttgatctgcgactgaatcgcgttgttttgctcctgaagttgtttgtaccggtcattcagctcgtcaagcatgtcctgaagctcatccgactcctcgtccccgccgtcggaatcaatcagctcgctgtcgtactcctcgccgtcgtcggcgcgcaccaaaaccgaaatcgttggcgcgaccaacatagcggccattaaaatagccatcgcccatgcgaaaatccgtttccctctggaattcaacgcaaaacctcccccgcagtcacagatgatccaacccaaatgataccaatgtctccgattttcatgcagccctataccttcaggtacctatttacaaagaacatgctcccgaacacgccaataccgatgccgccgcccgcgaaccacgcgaacattttcaaagcgacatcctcaaacgcaagcgtgctgtcgagcgcgctgcggatcagcgtcgcggggctgtccgcaatcgtctggagcacgtagtcgtagccgatccataaaagaccgaatgcaatcagcgccgacaaaagcccgagcaaaaagccttctacaaaaaagggcaggcggataaatgaatccgtcgctccgacgtatttcataatattgatttccttgcggcggttaaaaaccgtcaccttgatcgtatttgcgatgatcacaagcgacacaacaatcagaatcgccacaataaacagcccgcttatcgatacggcgcgtttgatgcttgtgaacgcctccgccacggaatcaggagcaaggattttatcgatgccttcgatctcctcaatctgcatgacggtacctgttaaaagcgacagatccctaatattgacgcggtaggaattgaacaaggggttctggtcgccttcaagcccggatatcagggaggccagctcctcggactgcgccttctgctcctcaagcagctcgtcctttgagacatatgtcttgttataaatattgtcgatcatatcaagctgcacgccgatatcctcgatctgcgcatcatcgaggtcgtcactgaggattatatcgacctcgttctgctgttccgcgtatccgacgatttgattgacgttcattgaaaacaaaagcgagcttccgatcagaagcatacacgccaccagcgtgccgatcgacgcgaacgacatcaatctgtttgcatagacgcttttcgcgccttccttgatgaggtacccgaaactgcttcccctcattcgacgtagtaccccctgttcctgtcgtccgaaatgacggtcccctcgtcgatcgtgatgacgcggtggtcaaattcgttgacaagcgtgtgctcatgcgtcaccatgacgatggttgtgccgcacttattgatctcgctgagcaaatcgacaatctcgaaggaaaggtccggatcgatgttgccggtcggctcgtccgcgatgatcagcggcggattgttgacaagcgcgcgcgcaagcgcgacgcgctgctgctcgccgccggaaagatgctccggcaggctcttggccttgtgggaaaggccaacgagtcccaatatgtaaggaacgcggctgcggatctccttgccggagacgtttgtcacccgcagcgcgaaggcaacgttgtcataaacattcatattcggaatcagccggaaatcctgaaacacaacgccgagcgtcctgcggtaatacggcaccttgcgccgcttcatgcgcacaagattctgaccgttgacgtacacctcgccggacgacggcttttcctcgcgcatcatcagcttgataaacgtacttttccccgcgcccgacgggccgacaacgaatacaaactcccctctgtcaacgctcagactgaaattgttgagcgcatgcgtccccgtgtttttatacaccttggagacattgacaaactcgatcactggtacaccgcctttgaaaaagcctgtttcggggcaggctctgtttgtgcgcgcccgatcaatatttaaccggattcgccgtcaggtattttttgaccatcagcgcgaccttgaaaataatcgcatgatcaaattcacgcagatccagcccggtcagctttttgatcttctccaggcggtagacgagcgtatttctgtggacaaacagctttcgtgatgtctcggatacgttcaagttgttttcaaaaaacttctggatcgtaaacagcgtctcatggtcaaggctctcgatcgagcctttgcggaacacttcgcgcaggaacatgtcgcacagcgtcgtcggaagctgataaatcagacgcgcgatccccaggttgtcgtagctgacaatcgccttttccgtgtcgaacaccttgccgacctccagggcgatctgcgcctccttgaagctgtgcgccagatccttcacaccgacaaccgatgtgccgatgccaacgacaacctttgtatagaactcgctgccgagcgtgtcgacaattgagcgcgccagcttttcaagatccttgctctcaatgcccggctttgtctccttgacgagcacgatgtcgctttccgagatgttaaagacaaagtccttctgtttatccggaaacaggttctgaataacgtcaaaagcggagatatcgtttgacgccacaatgcggatcagcagcacaacacgcgtcgcatccgtgttgaaatgcagctcgcgcgccttgacatagatatcccccggcagaatattgtcgaggatgacgttcttaatgaaattgttgcggtcatatttttcgtcgtaatactgcttgatcgacgaaagcgagatcgcaagcaggttgcagtacttggcggcaggttcgtcaacgccttcgacaaatacggcaaactccggtttcattttgctgccaaacggcttatacgtatagccgtcgcggacaaatacctcgttcgcgtcgccggcgtcaagcgtaaaaaagtcgctagtctcgccgattttggtcagatcgctgcaagaaatgatcgttgcgctgtcgtccacaacgccgatcacacggtcgatacaatcgcgcatctggtgaacgatcccctgaaaaagcctgtttgacacttcaatcccctctttacttgtaattcggtggtcttgccaaacgaaaaagcgggttcttccctgctggcagcgcacagattccacgctgcaaatgtccttcggaaccggtggaattgtgtggattttgaatgattacaagccatcacgaatattttacaacaaatttgtatattttgcaacacaaattcttttacttgttgtggaaaaatgattatttttttccacagcgatttcaatgcggggcgccaaactggcttttggcctatcatactacaatttgagaaaaaaattgtgaccaaactttgtcgcttttttgaacagcttgtccccccgtacgatcacgcatcgaccaaagcgatccgcgccgcctccgccgcgctcagttcgcggcactctcccggtccgagcgcaatatcgagcgaaagccctccgatccggtcacgccgcagcgccagcacatgcgcgccgcatgctgcaaacatgcgcttgatttgatgatacatcccctgccggattacgacgcgcgctgtatccggcgtatccagcacgcacagctcggccggcatacatacagcgccgtcgagctgcacgccggcggcaaacgcctcaatcatctgctgcgtgaccggcgcgtccagccacgcggtataggttttcggcacatggcttttcggcgcaaggatgcggtgtgcgaacgctccgtcatccgtaatcagtacaaacccttccgtatccttatccaagcgtcctgctggaaacagaccgcggcgcatcaggctgtccggcacgaggtcgagcaccgtcggcagcgcggcgtcgctcgtcgcgcagacgacgccgcgcggcttgttgagcatgatgtaaacatggcgcttgagggcgagcgtcttacctgaaaccatcaccacatctgtgtccggatcgatcttcaggtcggcctttttgaccggcgcgccgtttacagagatctgcccgcgtccgaccaggcgctgtacatcgcggcgcgaaagcttcgtctgcgccgcaatcaccttgtccagacgctcaagcttttgcttttggggcatcaccgtttcatccctcccgttcccactgttcccggcccaaaggtgtagacttttattttaacacaagcacaccgcacatgcaagcgcgcccccggcggtccgtttccaccattgcaggccatgcttaaatacggtaaaatataactgttaaccttgaatatacaaccaaggggggatcaggatgctgacaaaaccatattacggctggaccgatttcagccttgaaggcacttctgtctatggattgagttatcttgacgatatcgcttttgaatggctcgatcaggccattcatggattggaaacgatgcttcccttttgtgtcaagggctttcttgagccgggcaggatgttgtgcaccgtaagcttttggaattgccatattgttattgaagacgatgaaagagagccattaaaaaaggagtctgtcataaatgagtattcccataccagtatgattcatttttgtaagtatttatatagcgatatcagcagcaatgttggtgaatgggcttcatttgtggattaccccaaggtggatacggaacaaaagcggcggcagcttcttcaaaagctggaaaaattaaagcagcttatttctgaaagcgaaccgtcctttggccaagaccgttgttttctataatcaaatggctccgattaattgagccgcagaaggccgcctccccttttttggggggcggccttggttttttgtgcgtttgtctgcaccgcatcctgttgtacggcgccttacgccgcagcatcggatgtttccggctgcgatataacaaagccatgcataaatccgccaagctccagcgaacagacatccccgccgatcaccttatccttatagaccaggatattcgcgcgtacattgtccgtctgcccgggataattcgtcacaacgtatgtataccgcttacaccgttttccggcatatttttcgagattgcagccctgcgtcttttggatcgcattgtagtttgtaaacacgtcgtcaaactccttggggatctgcacctcgacaacctcatccgcctccggttcgacctgccagccgaacgactccaaaaaatcgatccgctgttcctctgttttagccgcagcttttgcaaccttgacctcgctgtccgcacgcacagggctgccgcgcagctccgagatcgccgcgcgcccccagacgccgcccacaagcgacaatacaaagacagccgcagcggcggcgacttggcgttttgtcacacgaaatgaaatggtaaacatcgttttctgcctccccgcgctcatttgttcgttttcatatatacgcgtccatcgcatatcttatgcgccgccgggcgggtccggacaaaaataggaccgccccagatgaggcggtccttgtatataaaacggttatgcttcttcttcgttcatctttttggcttcttcaatgacagaggcttcaagctggctgggcagcagctcgtaacgctcaaatttcagggtaaagctgccgcgtccctgtgttgtcgaacgcagaaccgtggcaaaatcccccatctcgctcataggcacctcgccctcgatgacctgcatgccgtcctcgtccgggttcatgccgagcacacggccgcggcgcttgtttaattcgctgatgatatcgcctgtgttcgaatcgggcacgtaaaccttgagattcccgatcggctcgagcagcgccggcgacgcctgcggcatcgccgccttatatgcgagcgacgcggctgtcttaaacgccatttccgacgagtcaaccggatggtacgaaccgtcgacaagcaccgccttcaggccaaccattggatatcccgccaggacgccgtgcttgacacagtcctgaaggcccttttcgacagccgggaagaagtttttcggcacggagccgccaaatacattctcctcgaacagcagcccttcgccgtcatacggcgagaactcgatccacacgtcgccatactggccgtggccgcccgactgcttcttgtgcttgccctgcaccttgaccggcttgcggatcgtctcgcggtaagcgacgcgcggcttggtcagcccgatgtcgacgccgaactttgatttcagctttgaaacgatcacgtcaagatgctgttcgccaaggccggagatcacctgctggtgcgtctcggcgttctgctcaaagccgatcgacggatcctcctcgatcaaccgctgcatcccctgcgcaaccttgccctcgtcgcccttgttcttgaccttgacggccatcgacaggcacggctccggaaactcgacgcgctcgaacgaaacgatcttcttcgggtcgcacagcgtgtcgcctgtaacagcacccgacagctttgtgacagcgccgatgtcgccggccgtgataaacgcggtgtcctcctgctttttgcctgtcatgtagatcagcttcccaaggcgctcctgctcgccggtgcgcgagttgacaggcgccacctcgcccgacagcttgccggaaacgaccttgaagtagcttaacttgccgacaaacgggtccgcgacggttttgaagatatacgccgcaagcggcgcttcgtcggtgcaggcgatttcaataggttcgccggaggcgtcctgcgccgtttccgagccggcttcccaagcagaaggcaggtggtcgacgagcgaatcgagcagcatgtcgatgccttcgagcgtcgcggccgaaccgcacaacaccggcgtgatcgcgccggtgtgcacgccgttgtggatgcccttgatgatttcgtcgcgcgtgaactgctcgccggagaaaaatttctcaaacagcgcctcgtccgtctcggcgacggcctcgctgatcgcgccgatcaggccctcgaagcggtgcgcgatatcgggcatcgcgacctcggctggctcgcccttttcgttgtatttatacgccttgttgtcaacaaggttgatatagcactggaccttatggtcctccacaaccgggacgacgagcgggcagatcgacgggccgaacgacgccttcagatcctcgagcactttgtagaagtcggcgtgctccgcgtccattttgttgacaaagaacattttcgatttgcccatcgaatcggccagcttatacgccttctgcgcgccgacggtcacgcccgaacgcgcggaaacaacgatcagaacgctctcggccggccgcacgccctcatacatgccggcggcgaagtcgaacagtcccggcgtatcgatcagattgatcttaacgctgccccatgcgaacggcgcgaccgcgcttgagacggacaccttgcggcggatctcctccacgtcaaaatcgcacacggtattgccgtccgcgaccttgcccaatctatcggtggctccggccttgaacagcagcgcctccgccagcgaggtcttaccgctgctgccgtggccggcaattgcaacgttccggattttacctgctaaatactgtctcataccttgctccattccgccgcttcgcgccggcaaaaaatgtaatgaacacgccgccccgccgcgcgaagggacaggcgggagcttctgcgcgggatgattcccatttgcaacgcattcgtcataatcgccaagagacgacctttcgcccccacagcattatattgatattatataatctattgaaaaacttcgcaagggattcctgtctacatgcactgtataaataatctttgctaatttgtatgtattgcacaatcagcatgtcaaaaagaggagtggttttgctgcttgcaaaaccactcctcttttaaacgtcagcgacgtgccagagaaacgaccgacgtgatcaccagccaggccaggccaaacagcagcagcatggcatacgacgccagcttgagcgaatttgtaaacgacataaacgcaacaagcccgtatccgacaattgtcccgatcagttgtataaccgttgcgctcatcacagagttcctgacggccgccgccgcgtcaagcagcgccagtacgccggacaggccgcccgcatgcaggccgccggccgcgacacgcgggcggtccttcgtcagccaggcgtattcgggatgcagcttcatcgggagaatacgcacctgtgtacgcttatacgagaacactgacgcaatcaactccggcgtcacatttgggttggtcgtgtagatgatcaacgacgtacccctgcgcgccagccccgccattgcgtccataatatccggcgacgcgttatagctcacaacgaacatggccgacagttcgcctgaattggcaatatagagcacctgacggccgtcacgcgcataacgcgcttcaaaatcgcgcgagggacagtcgatgtcgtgcatccgcatcaattcctgcgtaccgatcagcacacgctttccatccacccaggccgagattcccataccgtcctcataaacgaggttatcgacagcgcgcagcatccgcttgttgttgccgaccatattgatgaacacacccgacaaaataccgccgcacgagagaattacactcgctgcgtcgagaattgcctcgtcgatgcgcttttcagcaaacaccttcatcccatgcagcatcacgctgtcggccgggaacaggtctctatcgctgatcacaacagcattcgtatcggtgtattcctcagccgatacatacccggccaatagcgccccctggcgcgcaagtctcttggacatcttgttctgcatcaggttcggtacaatcgcgccggacaacggcgcacacacgcacagaactgcggcaaaagccgacactgcaaccggcagggcgcggtccgccatgaaaaacgtcacaaccgcgaccacgattgcaccaagcagacagatcggcacggcgatgcttgtaaatgccaggctgtaatcctgcgaatagctcctgtttaaaaatcctgtcagaaaatcgaccttcgcgctgcacgccacaccatccgcatcaggcggcagtccgcgcgcaaattcacgcgcaagctcgcggtcacggatgcgcacgagcgcgtatttgtcctgatcgtccatcaaagttgtaaagtcacgctccacacggcgtaccgccatgcgtttgcccacaagcgcgaaaaacagcgcgacgaccgccaccgggaaataaaggctgatctgctcatacgccgttaccgaacccggcagaacagccagcacaatgccttggatcagcacggccagcacggccagagccgcggacgaatcgctgtttgcgcgcagacggcagagcgctgaaataccgcctcccaccacattgcagcagaacagcgccgcaagcgccacgatcacaaggtttgcaatcaggaacagccgcatattgttttcaggtgcgagcgcgggcggcagcggaagcaggccgtccttgacaccgattttttcaagcgcaggcgcagcgcgcagggaaaccgtcaaatagatcgaaataaacgcgaaaataaatgtaaagaactgcttgacgccaagcccgacacgtatcgatttcagatcggccgcgacctcgggcgcgtcctccggcgatgcaaactcatcgtccgggtcctcatcctccagcagcgactgctcatcataggagcgccgccagcgcgattcggcaagctgcgccgattcatccatatcggcctcccgcgtgccgctttcaaacgatgggcggcggtcatgccggtgctgcgtgccgcgtggcaccggcgtctcctgatgcgcgccgaacgcaaacgcactgtcctccggcggctcctgctctccaccgtctgtcagatcgtcccacaacggcaaatcaccgtcgtccggtgcgccgaacagagcctccggctggaccggcggctctccgcgcacgcgccgcattgtctcgtcgagcgtctcgcccgcaaatggatcgcggccatcatccgcatcgcccgcatcgaacgaaaatccgcccgctccctcatacgacgattgatcgccgccatattctgggtgctcctcatacagatcgcgggctgcacggcgctgaacatatggttcctcatacgggccacgggccgtgcggcgctgaacaggcggttcctcatatggctcgcgggccgtgcggcgctgaacaggcggttcctcatatggctcgcgggccgtgcggcgctgaacaggcggatcatagtagcgttcccgtgccggacggcgctgcgcaggctggtcataataacgctcacgcgcagacgggcggttcgtctgtgtgtccacgcgccgctcccgctgcgaacgccgctgcgctgatgtatccgcattgccattctgtgcggaagcacgcgcatgagcggctccttcataggtgcgtccgcgcggcgcgcggccggacgctgccggacgcgcatcagtatatgtatcgcgcggcggcgctgcctcgcgctgttttttcctgcggatttcctccaggatatcgtttacatcgtaatcttgcggcatgtgcgattcctctctttattactccggatcatgtgctctctatctctttgtccgctggcggacggcttcatacatcaaaatgcccgcggcaaccgacgcgttgagggagttcacctcgccgcgcatcggcagcgacagcagcgcgtcgcaggtttcacgaaccaggcgcgacaggccgaatccctccgaaccgatcacgagcgccgatggaccggtcagatctgtttgatcccaccgcgcgcccgacgcgtcggcgccgtaaatccagacaccgcgcgccttcagctccttgattgtgctgacgaggttcgtcacacgcgccacaggcagatgctcgacggcgcccgcgcttgtgcggccgacgatcgccgtaaggcccgcgccgccgcgtttagggatgatcagtccatgcgcgccggcagcctcggctgtgcggatgatagctccaaggttgtgcggatcctcgatcgaatctgcgatgaccagcagcggcggttcaccgcgcgctgccgcgcgggcaaaaagctcctccacggtacagtagtggaacgccgcggcctgcgcagccacaccctgatggttcagcccgttggcaagcgtgtcaagcctgcgcacatcgacgcgcttgactgggacgcgcgcctctttcgccaaagcgacaatacgcgagatcggctggccgcgcgcagggacatcgtcacagatgtaaatgcattccacttcacgcggacccttgagcagctcaatgaccgcgttgcggccaagcacaagcccttcctccagatcgcgcttcgggtttgaatttcccattgacagcctcctgaccgttttgccggccggagccacccccggcggttatacgtcctgttttatacatagcatattataacatagccgcatacaggatgccatacgttccgcacgatttttgacagattttaataaaattcatcgaatccgggccggccaagcctgtccgaagccaactgtgcaagcaaactcaatggaaaggtacaggccattacaacaggaaaaataagcacgccaccgccgctcccccgagcgccgcgaggccaaacttgacagcttctgtcagagaaaatctgcgcggcgccgcttcgcgcgggctgtaatcgatctgcgaaagatattccccggccttcgcacgcagctgcgttttatcgccctcctgtgcgtttggccgcaaaaacaggatggccttttcaaaatagcggttgtctgtgtgcacaacctcgatcaccttttggctgactcccttgagcaccataaaatcccccttgcccgcgcctgattggattgatcttttgggtctgccgtcaaaaccgcggacaggcgctgccgctttgtccgccaacagaatccttttccgctcgtccccgcgcggccgggacagcgtaacgcatttcgcttttctattttggtcgccatgcggtcaaatattcccttgtcaactgccagattgcacaaaaaaaatacgctccggatcggagcgcatttatacacgccgtaatacaaaaatcagttctccacacgctttgttttcccctatgtggaaaactctgtggaaaatggggaaaactccgcatcgttatgcgtttttctcaacagacaggctttcaaccgatgtaaacagcatccgaaagtatgaagaaacaatgaatactgcttgtagattggataaaattcccttgcatcggattttatacaggatgctcgaaattttcataatttccatctttctttcggcactgtgccctgttatactggaaaggccatcacatttacaaaaaggagcgcattatgacgcctgttatgaccgaatgcgacgaattatcacttccatacgacacagttctcgatgaatcgcccgatttcagcctgccgcagacgcttttatgcgggcaggcttttcgctggaggcaactggatcaaaacacctttatcggcgccgcctttgaaaaagtatgtcagattgcacagacgaacggaaaaattgtcgtctcctgtcagagcgcgggggattttgacgcggtttggcgcggttatttcgatttggaccgcgactacggcgcgctcaagaatcgctttcgcgccgaccccgcgctggccgaagccgtcgcgaaggcccccggcatccgtgtgctgcgccagcagccctgggaggcgctgtgtacctttatcatcagccaaaacaacaacatcccccgcatcaccggtattgtcgggcgcatgtgcgcggcattcggccggccgctcggcggcggctggcacgctttcccgacgcccgaagccatcgccgcgctcgcgcctgacgcgctcgcgccgctgcgcgccggctttcgcgcgcgctaccttgtcgacgctgcgcgccgtgtcgtctccggtgaggtcgacctcgaggcgctcggcacgctcccgctcgacgaagcgcaggccatgctcacacgcatcacaggcgttggcgtcaaggtggctgcatgcacgctgctctatggctgcggccgtgttgaatgcgtgcctgtcgatgtatggatgcggcgcgtgctggaccgcctctatcccggcggcatgcccgcctgtacatatggatacgagggcattgcacagcaatatctttttcattgcgcgcgcaccgatccgggctttctcgaccgggccgcccgcggacgccaccgattgacatatttcgaggattctttataatagagatatgattctgtttggggaaacgggcggtgattgtcaatgacctacgcgcagttccggcgcatgaaacccaaatataaacggcgcttgtttcttgtgatcctttgcgcagccgcgctggcggcggctttgctgttcggcgcctccaagggggtgcaggcgatccgcgccgcgctcaacacaaccaccatcaaggacgcaacggcagccaatgtgcttgaaaaagcaaatatgaacaaaatcctcgaaattatggggcaggaggatgcttccaatatctgtgtcctcagcagcgaggtcaagatgactggcgcgggcgctgtgacctctgtgacacttgacatgacaaatattgtaagcgacggtgtggccgaatcctggcgcctgacggctacggaaaaaaaggcgcgcctgtataaatctgaaacgcgttatgaaaatttgaaagcgcaaaagatcagcaagatggatttcaaatcctattatcccgccctttcgcgcgtcacgtcgccggaatttgtaggggaactgcaaaagcggaccggagccggagacgcaggcatatacacctttgtggacgatttcggcaacaaccgcgacccggagtacgactcctatctgtcaggcggacttgaaggcatctgggtatcaaatatcggcaaaatctcgtctttcgaggaaggatttgtccgctccaatacatgtgcgccgacgcgcgtgaccgttgaagccgtggacacagaaaagtcaaagggcaagcgcgtcgtcctgcttgcgcccgaggagcggttcatcgtcctgtttgaagcgggcaactatcagtaaatcaagcgctctgccaaaagcgcccggccaatggccgggcgctttttcatatttttcggccgccggcggcgcaccgttttagaacctgtattgacaggtcagaacgccgtaccgcgcgccggctccccggcttttgcctgtgtctgatcttcctttgcggctttcgccgtggttgtacgggtcgtaccgccagaaacataaacgctgccgcactccgggcagatacctgtatggatcgtcaccgtctgcgaaatcacttcgcgcccttcgcgctgggccttggcctgctcacggacgacgtgctccatctcatgtccgcgcacggcggatgcggcccgttcgggcgagatgctggtcggcgtcttaaaggacacgcccggatcgttggaaccgtcctgatatttgcgctccttgcaggtctggcattccgcttcctccatggtttcccgcggggattttccggtttcctcctcaatatcgggataacgaaaccggccgcgtaccgccagctccaccggagcggtcccttcacggtccagtggaacaggcgcggtaatcccaaacgtccgcgtgggattgtcctgcggcgccgcggccgtcaaagccggttcggcggcctgcacaggctgctctccggcatttctctgccatccgtactgagccggcgcatacgccatcgccgtctgccagccgtacaatccgattcccattgtatgcacactccttcagagcatctttttcctaccaatgataccacagcggcaacaaaaccgactttttcggtttcggctgcaaacggcaaaaccgtttgccctacgcatattatattgcacattctgggaatccacaaggtttcttcaaataaaatttcacgttttgctcaaacaccgcgctccagcatcaatacaatcacggtgatgtcgtcctcatggccgtcgctgcggcggcgcttcgactccgcggcaagctgctcgctcagctctttcggatcgtcgccagcataatgctccagatccgatacgagccattcaaacccgccggcaagcgcgccgtccgacaccatgaccacaaggtcgccctcgcgcagcgtaacggtgttcttttcaaacgtcacgccgccaagaataccgaccggcagcgaactggattcgacatagccgccgcgccccgacttgcgcaaaaaggtcggcgcggcgcccgctttataaaaatcaacgcagccggtgtagaggtcgacgccgacaatatcgatcgttgaaagcgactcgtcgcccgatttgaccagcagcgccgagttgacaagcttgagcgccgcgtcgaggctgacgcccgcttcaatcagccggcgcaacagctcggcggtcatcgtcgaatcgacggccgccgccccgccgctgcccatgccgtccgacaggatgacgttgacgcgcccgttttggccgtccacataacagaagctgtcgccgcagagcttcgattcggagttgccgagctgcgtcgccccccatttgaccgtataggccgccttttcagcaaaggtaagtgttgtggcggcgcactcggagcggctgtgtgtcgcaggcaggtcgaaatcgcgcccacagatatcggacagcgccaccgtcaattccgccatatcgagccgcgagagcttataggtcggaatggtcacttcgacagtcatattggcgcctccgtcaaccgtacaggttacgagatccggaaataccgtcagtgattgaaggtattcgcgtacctttccggcggcggccgtatcctgtgtggccagcccgtccagatcgcggcccatcgcatcgaccatcagcgccatcccctcgaactgatccgttacgacgccgcgcacctgcgccaccttgcgccgcacgctttcccgcgcggcgtattcctcaaacaagcggttcatctgtacggcaagctccttgacacgcgggcatgtcttaacaaaatactgcggaaaatcgttctccgtcaattcccctccgcgccgcaacacagagagcgcgttattaaaaacgtcgcttgtgtcggtgtagcgaagctgccagcaagtcgcgtttccgcggcatttgcggcagacacggtcggcggcgcagtgatagacggacgacagatcgccgtttaccataccggacaggcgttcgttgacctggcgcgttgtctcggccacatcacgcagcgcccccgctacatggtcgatgcggttcgtaagcatcgccttatacgtatcgccctgtacagcggcgccctgtccctcgcgcacgcttttcagacggcgcagcgcgccctgcggaatcaaaattgaaatcaggcttgcaataaagatttcaatcagcagatagcggtcgagcatacggcgggaagcgagcagcgcgaacaggttaacgacgatgaacgcgcctgcgctcgccgcgcgtcccaccggcgcgaatacaccggcaagcaggccgccaaggccgtaggtgcccattaagaacgtgtaatttccgcccacgacacccgctgcgacgcctgccgcgacgcctgcgatcgcaccgccggcctcacgggccgcctgtgcagcaagcaaaatcacaagcactgccagtacgcggccaacggatacgccgagcacccgcagattcacaagcgccagcacggcgataccgaaggtgatgacaagcgaggtcacatcggtctgacgcatattctcgacgccaagctcaagcgcctgggcggtgcgtgtgaaaaagtaggacgcacagcatgcaagcagcacctccgccacagcgagcgacgcatcgtaaacgctcccaccgcccacaaatacgattgcaatcgacggcagcccaagcgatacagcggtcagagcctgtccggaaacgcgcgcacaaaatcgtgtcagcgttccggaaccaagcatgacgcgcagtccgaacaacagcgccatcgcaacgatgtacttgacattggtcatcatatgaaacgacatcagatagccaagcgtcgcgccaagcgtcgcgccggcataatagcgcggcttggccgaggcagcgaacgcaatgccaaacggcgcaagccccccgagtacaaacgcattggccgcgacaaaccctgtcgccgcataggcgaaatatcccgccgccagccgatgcgcgcgcaccgtctgcctggcccgcgcgccgatggaaagacccgccgctgtcctgttctgcatagccttcacctgtttttcatatactagcaagttatccttgttgtataatctattgtaaatattgagttctgcataaccggtcgaaacacgctgtcgattcatgcgaatccataaaaaagagcggccatgccgctcttttttgcgcatatgccttaaagcagtctgattcataggcacaatgcgccccattttttaacagcgcagcgtattccgccattgaaaacacctgcaccatatgatagaataaggcttagaatttcgcgcgttaaagcgcagatcccaccatcttgaaaggacggacccatcatgaactatcaattttccgaccgcatggctacgctcaagccatcgctggttcgtgagattctcaaagcgtcctccgacccggaagtgatcgccttttccgccggcaaccccgcgcccgacgcattccccgtcgaggatgtgcgccgcatcgccggcgagatccttgacgatgctcccatcgacgcgctgcaatattcgatcactgaagggtatgcccccctgcgcgaggcgctcaagcgcatggtccagacgcattacgccatcccgttgagcgccgacgatgatctcatcgtgatctccggagcgcagcagggcatggatttggcggccaaggcgtttgtcaacgaaggcgataccgtcttatgcgaggacccgtctttcatcggaagcctgaattgttttcgttcctataactgcaaccttgtcggcgtggggatggaaagcgacggcctgaacaccgcaaagctcgaacaggcgatcatcaaaaaccagaaggtcaagctgctctacacgatcccaaatttccagaatccaaccggcattacaacaagcgctgaaaagcgccgcgaaattctgcgcatctgccgtgaacacggcgtcatggttctggaggacaatccatacggtgatctgcgcttttcgggcgagcctgtcgcgccgatcaaatcaatggatacagacggcgccgtcatctatgtcggcagcttttccaagattctcgcgccgggtatgcgcgttggatttgtgctcgcccccaaagcagtcattgccaaaatgacggtcggtaaacagtgcgccgacgtccatacgaatatgctcgcccagatgatctgcgatcgctggctggccacctgcgacctttcggcgcaccttgagcgcctgcgcggcatctatcgccgcaagtgccgcctgatgctcgaatgtattgaccgtgaattcgcgccctgcgtaacgcacacaaccccggacggcggcctgttcctctggtgcaccctgcctgacggggccgatatgctcgatttttgcagccgcgcagtcgcccaaaaggttgcagttgtgcctggcgtcgcgtttctggccaatgaaagcgatccgtgccaaagcttccgcatgaacttttccacaccgaccgacgaagcgatcgtcgagggctgcaaacgcctcggcaagctgacgcgcgaattatttaactgaggtgataacgatggaagaaaacaatatccaatcggctcccgcccgtaaaaaacgcattttttcaggcatccagccaaccggcacctttacgctcggcaattatcttggggcggtcaggaattgggtggagcttcaggacgaatacgattgcgtctattcaatcgtcaacatgcatgcgatgaccatccgccaggagccgaaagccctgcgcgacaatacaatttcggcgctggcgctacttatggcgtgcggtatagatccggaaaaatccatcctgtttatccaaagccatgtgcgcacgcacgcagagctttcttgggtactgtcgtgctacacgcagttcggagagctgtcgcgcatgacgcagttcaaggacaaaagcgccaagcacccggaaaacatcaacgccggcctgttcacctaccctgtgctgatggccgccgacatcctgctgtaccagacggatcttgtccctgttggcatcgatcagaagcagcatttggagcttgcgcgcaacatcgcgcagcggtttaacggcatctatggcaatgtgttcgctatccccgacggatattaccccaagcttgccgcaaaggtgatgtccctgtccgatccgaccaaaaagatgagcaaaagcgacgacaatcccaaggcatacatctccatccttgataagccggaaacgatcgtcaagaaattcaaatcggcggtgacggattccgacgctgaagtcgcataccggcagggcaaagatggcgtcaacaatctgatggcgatttacagcgttgcgaccggccgtgatttctctgcaatcgaggcggagttcgcgggccgcggctacggcgactttaagctcgcggtcggggaagcggtcgcggaaatgctgcgccctgttcgcgagcggtatgaccagtatatgcaagaccgcgcttatctcgaagcatgctatacgcagggcgcgcagcgcgcgctctccgtctcgtaccgcacgcttgaaaaggtctataaaaagatcggatttccagccgatctttttgcacccgtccggtctttttgaaaaaagcctctgtaaaaaccgatccggttgcgccgcgaacggagaggcggcctgcttctgaatacaccaggcaggctgcccgcagaaaacggccatccatggcgtcgcaaacgccgcggatggccgttcccgttttcataaattgcgatcagaataacagcctgacggcaagcgccgacataaaaaaaccggtgatgtcagcggtaagcgccgcggggattgtatggcgcgtatcgcggacacgggccgcgccatagtataacgcgacggtgtaaaaggttgtttccgtggcgcccatcataacgctggcgatccgcccgatcatgctgtccggaccatatgtcttgagcagatctgtaaaaacgaccatcgcgccgctgcccgacacagggcgcatcagcgccagcggcatgacctcgcacggcagccccaaaaaacgccccagcggcgacaatgcgaacgacaacagatccagtcctccgctggctttaaacatccccaccgcaaccacaagcgccacaagcgccggcaggattcgccaggacatttccaggccctccttcgccccctccagaaatacctcaaatacacgcacgcccctcatcaggccatatccaataatcagtacaaccgccgttggaattgcccatacgccaaacgcagtcattgttttttcctcctcagcggcgcaagcagcatggcggctgcaatgcctgccgcaagcgacacgcccgaagccaaccaggtcgccggcagaatatccagcggcacggacgcgcccgcctgtacgcgcagcatggctgtcgtggcagggatcaactgaattgacgctgtattaagtacaataaacattgccatcgcatcggttgcgcgcccgttggcgcgctgttccttctccatcgcgcagaccgccttaattccaagcggtgtggccgcgttgccaagtcctaaaaaattggcgaccaaattcatggttgctgcgctgaccgcctctccgtcaggatcaagtccatgaaacaaacgccttgtaacaggtgaaagaagccggctcaggtgtttggtcaggccggatgcctgggcaacacgcatcaagccgttccacatgcacatcatgcccatcagcgacaacagcagcgttactgcctgcccagcctgtgtcatggccgcttcagagagcttatccatccgacccgtcaaggctgcgaacacaaatgaaaatagtaccattcctgcaaaaatgtagttcatcatggccgtcatctcctgtcattgctctatgtatatttcacaaattgatttattatgtttcgtttaattcgacaaataacatcaagttttttacaattttgtttacatttctgcaaatttaagatatattgtaacatgaaggcatttttgcctaataggtcagattggaggtggatcaatgaaatcaactggcatcgtccgaaaggtcgacgagctcggcagaattgtccttcccatcgagcttaggcgcacgctcgacataaacgaaaaggattctttggaaatttatgttgatggcagccatatcatcctgaagaagtacgaaccagcatgcattttctgtaacagtgcatctaacgtcgtcaactttaaaggaaggaatgtctgtgccgagtgtatcaaggagctgtttgacgctaacagcaaaaaagagtgagttttccatcgtgtgggaaagaggaagtaaggcaatatcggcctgaacaaaaaagcacaggacatttttgtcctgtgctttttcgttgcccgtccgctcccgccgtctataccggcgggtcatgtggatttgagctgtcgccagagccgccggataactccctggtgcgctggctttccagatagtgatcgatttccggcttatactcacgcgtcctgttgtccgcgccgctgtccatatcatcatgttcgcttcgttcaatcagataccgtgcgtacattgcaagcgccgcgcgcgtataaggacccacgaataacatcaacccaagctgaaggaccaacaacagaatcataatccccaggatttgcagcgtcataaatacattgcttgcaaacggcaggaaaatgataagtcctaaaacagctacaagcggcagataccagccgataaacgacagactgaacagaaacagccgccccttatggccgtttaccttacgcaccccatcccgaatcaaagcgcgtattttgcgccccggatatgccgccagcagatacggagcaagaaaataccgcagccccacaattgtcaaaagcacggttgcgatcagcagccatacgaccgacagcagaaaagcaaacaggatgactgcgcgcggctgatcgccgcctgaaataataaacattgccgccattgcaaacagcggcgaatagagaagcagcgcccagaaaaacattttaagtccaatcataaaatgcaggccgatggagcgaaaataagtgcccgcctgttcaaaataggaaaagatcgtggtcaaactgtcatcggcgccgcctgtccttcggtaataccaagctaatacgccttgggaaagcggagtgacaatcaagaacagcagcgcatacaccagcagcgaaatgacaatagacgcagccgctacgtttgccatatcgtccaacgcattgccgggcgtcatcgcgtaatcgacaaaagcaggaacgccgaccacctgccgcatcccgttttccaacacattgatcaggattgtaggcagcgccatgatcagcatcgccaaaatggcacgcccccaaaatccggacagcgcccggcgtgcatttattttcatcatcttaaaaaaacccataaacgacctcctgccggcatgacgcgttaagagcagcattccggaatctattcgataaattgcgtcgatataaacagttttcccgttatccaggcagttcaatcctgttggaccgcccggcttgcatgttcgatggtttggggcggctatgaaagcaatttcaaagcattttcagccaccagtccgcccatctgcgcggtcgtgtaaaccggcagtccgccgcactggatatccggcgtgcgagccgtttcaagcgcctgcccaaccgcctgctccactgcggccgcctcctctgataagccgaatgtataccgcagcagcatcgccacagaaaggatcgccgccagcggatttgcaagccccttgccggcgatatccggcgcgctgccgtggatcggttcataaaggccgaacttcccatctccaaggcttgcggacggcagcagcccaatggaaccggagatcattgacgattcatcggacaagatatcgccgaacaggttgcctgtcactatgacatcaaactgtgacggattgcgcacaagctgcatcgccgcattgtccacatacatatgttcaagcgcaatatccggaaattccctgctgacacgcgccaccgtttcacgccatacgcgtgaggtttccaacacgtttgccttatccacggacacaacacggccatgccgcctgccggcaagcttaaacgcggttcgcgcaatgcgctccacctctgggacggtataagacatgacatcgcggccaaacagaactccattttgctcaccgcgcgtatgctctccaaaatatacgtcgcccgtcaattcgcgcaccaccataatatcaacgcccggcccgattgcttcatcccgcagcggcgaagcgccgcgcagcgccgggaatatcgacacaggccgcaggttcgcatacagcccaagcgccgcgcgtactccaagaagccccttttccgggcgcaggcttgcaggctgcgcatcccatttcggaccgcccacagctccgagcagcaccgcgtcagccgcacggcactttgcaagcgtttcgtccggaagcggcacgcccaccgcgtcgattgcagctccgccaatcagcgcatccgtgcgtgtaaggctgatttttttcacagtgcatactgtttccaacacacgcaccgcttgttctgtgatctccgggccgatcccatcgccggccagtacacaaattttcatgtccatcctgcctgtctccttttgttctggtattccgtttcccgctttttcaaaaaagcggggaaaaaaactttccggcctttttgaaaaaaggcctcggcgaaaaactttaattggctgcgctccagcctttttgaaaaaaggcttcggcgaaaaactttatccggctgcgccgcaaacagtgggacaagtttcagcattcatgcaggctgtgccgcaaatagcaggttgagcactgcgtttatacggctgcacctgccccgggggtgggtccatgggccaggggcggcttgacggtttaccacagaacgcaccggcgtgcgcccgacacgatcgcgccgaacagaggcggggataacataaggggaggccggcccgccccttgtgaggcgcgcttaggggcgcggccgcggctgtgggcaagccgctcacggattgcgtgcgccaaagcgggacctgccgccagcaaaatccgtgacagacgccgggcggctggcgcagattttgctccgcttctatcaaaaaaaacggtcaaacgctcctcgtaaatattacacacgtctgagagggatctgtccgtaaacctcaaatttatggtcgcgcatccacatctgcggcgtgagcagaagcgtgtaaccggcgcctggctgcgtattccagcgcagcagactgcgctgcggcagccccatggccgccagcaggttcataatcaacgttccgtgcgtgacaacggcggcatccgtcatccgctgctccatcatttgtgcaaaaatgtatgccaccgcctcgacagcacggccaagcaggtcggcgccgctttctccgttcggcgtgcgcgccgacggcggagcggcaatccaggcgcgaaacgcctggtcatgctcaagctcggcggctgtccttccctcgaaatcgccgaaatcaagctcccgcagcttatccaccgtctcctgctcctgactaggataaatcatttccgccgtttggcgcgcacgcagcagcggacttgtgtaaacgcgctgtacagacggatattcgcatccggcagccagctcccggagctgcgcgcggccctgctcacagagcggcggatcgctgcggccaatgtaacgcccctccagattggcctgtgtcagaccgtgccgtaggatgtggattttgtatgttaacataaaatatacgcctctttttgactttatttcacaaatatcagaatttttcgacacagtccctttacaaaaggttttgcgtattatataatttacaatacgtaaaggccttttgaacaggcgccaaaagcctgttaacaatagatagacaaaaaggtttttgaggggtattgacaaatgaacgctgattttccacgggtcctgacgttgctgcgcaaagaacgcgggatcagccagaagctcgccgcatccaagcttgggatttcgcaggcgttgctttcccattatgaaaaaggaatccgcgaatgcggccttgactttttaatccgctgcgccgatttttacggcgtttcctgcgattatatgcttggccgttcgccggaccgcaccggctccaagctgacggtcgaggacatcccggagccagattccgttggaaaggaaaacgtctttaaatcgggcgtgctccctgtgcttaacaaaaagctgatcgcaaactctctgaacattctgtttgacctgcttgcgaaaagcgcgtgcaagccgcttgtccatgaggtttcatcgtttctgatgctggccgtctatcggatgttccgcctggtgtacagcgccaacccgcgcaatcagagcgcactgtttacagtgcctgaaaccgtagcgcagcaatatgccgacgcggccatgcagatcagctgcgcaaacgccgcctctatctccaagggagatccggccgcaggcatggaacgcatcgccaatacagagcctctctatgtgacgactgaggcgctttcccatgattatccgctgtttgcctcgtcgctgctcaacctgattcagaattctgaagcgcgtatcgcctatcccgctccttccaagaagtgagcggcggcagttggatttttgatgctgcggcgtttccatctatccacgcccatggctttggagcaaatccggctgcatctatgaatattgtaccacatatacagcgtccgtgcaatctttgtgcgggcgctgtatattttcggcggccagcgtcggacggtttacgttgacatcacagcgccaatgctataaaattagaatgatttattttgccctgccgattggggatgagggatttgcaaggagggccgctttatgcaaaacaaaatagtgctgtccgcggtgcttctcgcttgcctgtgggcgttgagcggctgttccggcttcagctcgtcaacggctgatctcatgcgccccccgcgcctgacgccggagcagagcgccatcaacgaggccctcaccgccgctgcgctgacgcagacctatacgcttaaatatcccaaaagcggcgaataccgttcagcatttgtctttcatgacatcgatggcgacggtgtggaagaagcgatcgctttttatgaaccggatatcaacgatacggcgcgtattgtcctgcttgaccgcgagggcggcgtctggaaggcctcgtgcgatctggcaggcgcgggacaggatgtggagtttgttgcgtttgccaacctgactgcatccggctcaagcgacattgttgttggctggagcgcctccgacggctccgataagcagttgagcatctacacctatgcagacggaatccttgtcaatgggctaaaaggcggcggctccaatatggaatatgacgcctatctgatcggtgatttgagtggaaacgggcgggacgatatcgtttttaccggcagcagcgtgagcggcgcgcgcgacgcctattgggtcaagatggtctgttttgacggcaacgatcttgtcatttcagaccgcatggcgctttcggatcgcatcgacacgttcgccggcattacggcgggacgtatcagcgcctcctcgccaaaacacggcgtttttatcgacgaggttctttccaacgggatgcttgcaacagaggtattcacggtcaattcatccaatcggttcgagccggtcatcagcagcgccgccgaagcggaagcttccgcgctggccgcgccggcggaaagccccgacggcgatatttatgaaccggattataaaacgccaacgctttttgaacggacgttccgtgtcaatacggcttacagcgccgcaagctccgacaatgaagcggccgcgccgctttgcggcgacgcggacggcgatcgcgttatagaaattcccactgcctccgttctgcccggctatgaggagcaggccgaatccgaaacgctttatctgattgaatacaaccatcttgaaggcgatacgctcaagcgggcgttcgcggcggcggtcaaccgcagcggcggctaccgtgtgcgtttcccggacgaatggatcggtgcggtcacaattgtcaatcaggtggaaagcaacgaatggcgttttatcggctataatggcggagaggatccgctaaacgatctttctgttgaattggcgcgtatccgtgttgtatcacagaaggattatcaggataaatttcttgaaaattaccgcaaattcagccagacacgcggtatgttccaatactatggatatgtgccgccagcggcgtcaggaccgctctccgtcacatgggatgagcttcaggagatgttctctcttttgtgacgggccggagcctttgaaaggaaggatttaattatgaaacgcatacttgtcgttgaggacgaggatgtcatccgcgattttgaggttataaacctcaagcgcgccggctatgaggtggtcgatgtacccaccggcgaggaggcgatccaggtttttgaacgcaatcccacgcatttcgacgtggctgtgctcgacgtgatgatgcccggtatggacggctttgaggtttgccggcgtatccgtgaaaaaaacagctccatcggcatcatcatgctgaccgctaaaagccaggagatggataaggtcaacggcctgatgatcggcgcggatgattatgttaccaagccgttctctccttcggagcttgtggcacgcgtcgatgcgctgcaccgccgtgtcacagtcgccgctgaaaaggcgcaggcgcccgctccaagtgagctgaaatcaggtccgtttgtgcttaacatgaaaagccggaccgtatcgaaaaacgggcgcgtcctcgaattgacacaggttgaataccagattcttgaatactttttcaacaatccaaatacggctctcgggcggcaggatattctcaataaggtctggggagagggatatttcggcgacatcaaaattgtggacgtcaatatccgccgcctgcgcatgaagctggaggacgcaccgtccaagccggaatttcttttgacggtatggggcttcggttacaaatgggtgcagaaataagctgacgatttctggcaaaaggagggccgagtgtggccgtcaaaaaaatcaccaaacgctggatggtcaataacttcggcgtgatccttgtgatccttgtcgcgcttgaagtcggcttctcattcggtatcaaggcgttttattacaacagcgtcgaatctgtggtgctcacacaggtgaatgtcgttgcctcacagctggccgcctatgccgaggacagctccgccaactactccgagcaggtgcgcgggcttgtggaaggctttcaggcgcgtgaccgcatggaattgatggctgtggggcttgataaaaaagtgtcgtttacgtcaagcggcttcgaaccgggcggcgacctttccatgcctgatttcgatatggcgttgctttccccggacggcatcggtaaatttgtcggtacgatcgacggtgaaaagatcatggcgatcacaaaaatttctccaagcgtcggcgatcagcagctcgctgccatgcgctttgccgtgtcgctcgagttggtcgaccgccagatcatcctgttcatccttgtgattacgcttgtctgtatcgctatcatcttttttgtcatcttctccggttcctatttcattggctccattgtcaacccggtcggcgaggtgagtgtcacggcgcgcaagatcgcgcacggagacttcaacgcccgcctgaccaagaaaaacgacgatgaaatcggcgagctgtgcgacacaatcaactatatggcggaggagctgtccgccaacgaccgcatgaaaaacgacttcatttcctctgtctcccatgagctgcgcacgccgctgaccgccatcaaaggctgggccgaaacgttggccgatatgggcggcgaagtcgatccggaaatgcttgccaaggggatgcgcgtcatcacaagcgagacagagcgtttggtcggcatggtcgaggagctgctcgacttcagccgcatccaaagcggccgtatgaagctggtcaaggaccgcatggatgtgattgccgagttgtccgaggctgtgttgatgtttgaggaacgcgcgcgtcacgagggtaagcgcctgatctacaacgagccggatcagttcgcctcatttatgggcgaccgcaaccgtctgcggcaggtctttgtcaatatcatcgacaacgcgctcaaatactccgatcgcggcgacactgtgactgtccgcgcctctgtatcggaatcacaggtcgatatttctgtcgcagacacgggcatcggtatccgcgaggaggatttgcccaagatcaaggaaaagttttttaaggcgaattcaacgcggcgcggttcaggcatcggacttgcggtcgccgatgaaatcgtctcgctgcatggcggcacgctcgatatcacctcgaaggaaaacgtcggtacgcgcgttacaattcatctgccgcttggcaacggttgatttgttcatattttacacgttataataggacgcagacacaaggccctgtatgacaggccggaaagggctgattatttgtcggaaaattcctgtaaaaaagaaattaaaaagacctcgatcggcggacaggcattgatcgagggcgtcatgatgaagggtcctcacacttccgccatggctatccgcaaacaggacggctccatcacagtcgaaacctgggcgaccggcggcggcaagtggtactccaaggtgccggtcgtgcgcggcgttgtcaatttcatctccatgctctttcagggctacaaatgcctgatgcgttcagcggagctgtccggcttcgccgaggatgaggaaccgtccaaatttgacaaatggatggacgcgcatctgggcaaaggcgccgtatggatttttaatatccttgtcaccgtctttgccgtattgattgccgtgggcctgtttatgctcctgccatccgcgatcgtcaaatatgccggcgccctgacctccgcgcccgccgcagttttgacgttgattgaaggcgtgcttaaaatcgccatatttgtgctttatttgtttgcggtcacgcgcatgtcggatatccaccgcgtgtttgaatatcacggcgcggagcataaaacgattgcctgttatgaggccggcgacgaactgacgccggaaaacgccaaaaaatacatccggtttcacccgcgctgcggcaccagctttctgttgattgtgctcgtcgtttccatcctcgttttttccctgctcacctgggacagcgtatggatgcgtgtcgggcttaagttgctgcttttgccggtcgtcgtcggtatttcctatgagatcatccgttttgcaggacgccataacaacccggtcacacgcgtgatctcagcgccggggttgtggcttcagcgtttgacgactttcgagccggatttgacgcagcttgaggtcgccatcgccgcaatgaagccctgtattccggaaaacggaaccgacgatctctactagccggcccaaatgcgccgcggacctgccggtccccggcgcattttatcagtaggagcatttttctatgacgttgcaaatggcttatcaaaatgcatacgcgtcccttggaccggatttgtctgaggacgcggaattcgatctctcctgcctgtttgaacacatattcggggcgccgcgccgcgcgcccggcaacagcgcgcgtgaagccgacagcgcaaagcttgcggcgttcaatgcgcttgttgcccggtacaaggcgggcgagccgctgcaatatctgcttggcatgtgggaattttatggcctgccgttcgaagtcggaccgggtgtgctgattccgcggcccgacacggaaacgctcgttgaaacggcgcttcgtcttttgaaagggacggccgcgccggctgtcgccgacctgtgcgcgggcagcggatgtatcgccgccgccattgcgcacgcgcggccggacgcgcgtgtctatgctgtcgagctttccgatgcggcattcccttacctcgtgcgcaatctcgcgcgcaacgcgccgggcaatgccgaggcgatctgcggcgacgcgctcgcgccgccgccgctgccgccgctcgatcttgtcgtctccaacccgccgtatattgcgcgcgcagaaatggaaacactctccccgcaggtccgctgggaaccggaaatggccctgctcggcggcgaggatgggcttgatttttaccgcgcgctgccgcgtatctggatgccgctacttcgtcccggcggctatatcgcctttgaggttggttatacgcaggcggacacggttgccggccttttggggcggagcggttatcagagctgctctgttgaacgcgatcttgcaggtatccgccgtgtcgtctgggcgcagcggccaaaggactgatcttcgcatgcaagcccggttgggcgcggcttttcagccgcgcccacgccaaaagcgcccggccccacagaggggccgggcgcttttgctccttatacagcgtttcagccgatctggccgagcacacggcgatacatattgatataatcatccgccgagcgatcccatgaaaagtcgcttttcatcgccttttgaacggcttgcgcccacgccggacggttgtaataaagtccggccgcgcggtcgatcgcgccgagcatatcatgcgcgttataggtcttaaaggtaaaaccgttgcccgacaggtcaaggcccatatcggtgattgaatccttgagtccgcctgtctccctgacaattggcaacgtgccgtaacgcagcgaaaccatctgtgcaagcccgcatggctcgctcttggacggcatcaaaaaagcgtccgaaccggcataaattttgcgtgcaagatcgggaataaagccgatgcgcaccgctgtctttcccggatatttcgcctgcatctcctggaaaaagctttcaaaaatataatcgcccgaaccaagcgcgacaatctgaagctcgcgcttcatcagctcctcatagatatactggatcagatcgatgcccttatgcgcgacaaaacgtgtcacgatcccgatcagcatcttgtccgggtcctcccacaggcccatatccttttgcagatgtgttttgttgatcgttttacgttcaatcgtttttgctgtaaagttagcgtagagcgcgcggtccgtctcgggattatagctgattgtatcgatgccgtttaaaattccaatcagcttgtgctggttggcgcgcagcaggcggtcaagcccatgtgaaaaccatggatcggtgatctccttagcgtatgtcgggctgacggttgaaacgtaatcgcagacttcgattgcagccttcatcatattcagacagccgtcatacagcatagtcggagcggcatagtagggaagcccaagcacatccgaagcaatttccattccatatttcccctgatattggatgttatggatggtaaagaccgttttaatgcccttgtatttgtccatattgcggtagaacaaattgagataaacaggcgtcattgcagtctgccaatcgttgcagtggataatctcagggtcaaaatctatgtactgaatcatttcacagacagctttagagaaaaacgcaaaccgttccgcatcgtcatagaagccatagataccgccatcgcgcttaaagtagtattcattatcgagaaaataatatttaacgccgccatagcttgcttcaaagacgccgcagtactggttgcgccaaccaagcggtacgtagaaattacagacaaatttcatctcctggcgcagttccgctttgattgcgctgtacagcgggatcaccacccggcacgcgtgctgcttgccgcggatcgcgcgcggcagggaccccgccacatcggccagaccgccggttgcaatgaagggcgtcgcctcagatgcaacatacaagattctcatttacagattccccctctaaagcggcttttggccgtcaattttttacatagataaacacagccggtatcctatttcattttcccgcgccgcacggcggcgcgggaaatcatccgtgtcaaatggcgctgcccttgctgatgtaagtcggatatgtttcgtatccaattaacacacgcgaatccttgatcagtacgtccttatcggtaacgacatattcaaggtgcgcattatcgccgatataggtgtcctgcatgatgatacagtttttaagcaccgcaccctttccaatctttgcaccgcggaatatgatgcagttttgtacatcgccgttgatgatacagccgtccgcaatcaacgaattgcccacgcgcgccgacaagccgtatttaactggcacctgatcgcgtacctttgtgtaaaccggccggtccttcgggaataacgttgcgcgcaccttcggatcaagcagctccatcgaggctgcgaaatacgagcgcatattggaaacgcgctgggcgtacccttcaaacaaatacgccttgatattcagcttgccaagcgccggctgaatggcatggcgcacaagagaatagtgatcatgcccctttccctcgttgacaaggcgctcgagcagggttttttcgatcagcaggccattcatatagatggtctgcgttcccttgacgtctggacgcaccatgatatcggtgacatccatcgtctcctcgtcgcaggtgagaattgtcgtatcgcgcgccgtatcgggctgcacatcggcacgtctgcacatcatggtgatctgtgcgccggtgtggatatgctcgctgatcatatcgcgcagatcgatgttggcgacggtgtcgcagtcggcaagcagcacatatttcgcgttgttatgtcgaataaagctgatcgcgccctggagcgcctcgagacggccgcggtaaatgccgctggtctgactggcgaatgggggaatgatcacaaggccgccaaccttgcgcgcaaggtcccatgcgcggcccgcgccgacatggtccatcagggattgataattgctttttgtgatgatgccaatatcttgaatatcggcattgaccattgcggagagcacaaaatcgatcaaacggtagcggccgccgaacggcacggaaccggtggtgcggcgttccgtcagctctccgagcatactgtcgtgcatgttggagaaaatgatccccattaccttatttgctctcatgttgtcactgcaccccctcaatatcctgcggctcatccgcggccttcgccggctgctccacgccaggcacatcctgatcgatcatcgccttgggcttcactgtagcgcccgcaccgattttgacatcgtttccgacaacagcaataccccatgcgtcacggtcctccgcgttttccggacgctgtccgacaatcgcgttttcaccgatcacacagttttcagcgacgatcgaatattcgacaactgcgcccttgcggatcaccgtcccgggcatgatgattgaatcgcgcacaaccgcgccggattcgatggtcacgccggcaaagataatcgaaaaatcgaccttcccttcaatcgtacaaccctctgtcaccatcgaattctgcacaacagctccatccgcgatgtaatgcggcggcatcaccgggttgcgcgagtaaatcttccaactgtcgtcatacaaatcgagcggaacctttgggtcaagcaggtccatattggcttcccacaggctgtcaattgtaccgacatccttccagtagccctcaaacggataggcgaccatcttctgtccgtcggccagcatggcgggcagaatattcttgccgaaatccttcgacgacagcgggtccttctcgtcgtcaaccagatacttgcgcatcttgctccatgagaagatataaatgcccatcgaggccaggttgctcttgggcttgggcggtttttcctcgaactcaaaaatcgtgccgtccggatatgtgttcatgataccaaaacgggatgcctcatccatcggcacctgtaaaaccgcgatcgtgcagtccgcgtttttctccttgtggtacgcgagcatcttttcataattcattttataaatatggtcgcctgaaagaatcagcacatactcgggatcataccgttcaatgaaattgatattctgatagatcgcgttggctgttccggtataccagtcggaaccggagcttttctggtacggcggcagcacaaacacgcctccattggagcggtcgagatcccacggctggccgtttccaatatactcgttgaggatcaacggctggtattgcgtgagtacgccaaccgtatcgatgcctgagttgacacagttggagagcggaaagtcgatgatcctgtacttgccgccaaatggaacggccggtttggctaggttctgcgtcagcgtataaagccggctcccctggccgccggccaacagcatggcgatccattcctttttccgaaacattgctttacccccttatattctgtcgcgtccgcacagccccgctgcgcagacgtatcaatccgctttacgccttgccgcaggcttatccgcttttttcctaacggcggacttttcaacttttgtctttgtcttggccgcggctttcgtcgctgacgcagcttttgccttgcgcggacgccccttcagatatacggctgcgagcgggggcaccgtcaactcaatcgactgcttcatatcgtggtcggggatcttcctgacgcggatcgcccccgtatttacgacgccgcttccgccaaagcgcacatcatcggtgttgaatacctcgtcataagatgtggcgtccggcacgcccacgcggtaatgctcgcgcgtgaccggcgcaaaattacacagtacgacgatttccccacccttttcatcggtacggcggaatacgatgatattgcgcgcatgatcgtcgtgcgccagccaattaaagccgtcccatgaatcttcgacctgccagagggccggcgtatcgaggtaaaatttgttgagcgtgcgcacaaaatcctgcatctgccggtgcgcgtcatagtcgagcagcatccagtcgagctgctgcttataattccattcgataaactgcgcgaactcgcagcccataaacagcagctttttgccgggatgcgacatcatataagcgaggaacacacgcgcgcctgaaaatttcatcgcataatcgccgggcatcttattgatcagcgagcactttccatgcacgacttcatcgtgtgaaatcggcaggataaagttctcactgaacgcataaaacaggctgaatgtcagcttgtcatggttatagctgcgaaagatcgggtcgagcgacgtatacgcgatcatatcgttcatccagcccatgttccacttgaagttaaaaccaagcccgccaaccgacgccggctttgtaacaagcggccatgcggtcgattcctccgcgatcatcagcgcgtgcgggtgctctgtgagcacagcggtgttcatcttctgcaaaaacgcgaccgcttccaggttctcgcggccgccgttgatattcggcagccattcccagtcctcgcgcccataatcaagatagagcatcgacgcgaccgcatcgacgcggatgccgtcgatatggtagcgttcaacccagaacatcgcgctcgaggtcagaaaacagatcacctcgttgcgtccgaaatcgaagatacgcgtaccccagtgcgcgtgctcgcgcttgtggacatcctgatattcatagaggggctgtccgtcaaactcataaagcccgtgcgcgtccttgggaaaatgggcgggcacccagtccataatcacgccgatccccgcctggtggcagcggtcgacaaaatacataaagtcaaacggcgtgccgtatcgcgaggtcggagcgaaataccccgtcacctgatatccccaggagccgtcgtatggatactccatcaccggcatcaattcgacatagttgtatcccatatcggccagatagatgaccagctcatcggccgtcttacggtaatcgtatgtattaccgtcagggtaacgccgccaggagccaaggtgcagctcgtaaatattcatggggctgcggtatggattatggccctgccgcgaccgaaaccacgcctcgtcatgccactcatagccctcaatatcaaataatttggaggcggtttccggcgcggtctgcgcatgaaaagcataggggtcggctttcatcagggaacgcccatcccgtgtccggatacagtatttataaatatcgtactgcttgagtccttcaattgtacactcccagacagccttgtcctccaaaagcgccatgggattcgcatccgggtcccatgcattaaagtcacccaccacagagacggacgcggcatttggcgcccatacgcggaaagtatatccatcttccaaaccgcggcggccacgctggggatgcgcaccaagatattcatacgctttaaagttcgtaccctggtggaataaatacaatggcaagtttccggttttcttttccttcggctttaccattgccctcacctccttttttatattttaacagtatttggattacttttcaagtatttattgtgaaaatcccaataaaatcaccggataactcgaaactgttttatgtaatatgtacattttttatacactttcctgttcttttcgcctaatcgaacaaacaggggtggatttttgtgccgttcaaataattatcatatcacgtgcggcttgtcgaacacaggtctttttttgtcaatatagagcaaaattttccaatagagcattgctgggtaccgccgtacagccgtcctgcacggttaaagctttgcctgagctgctatgcggcgcaggcaggcgcgcaagcttttatacagaaaaaggcgccctttccgtttcacggaaagggcgcctttgaaactgttttacttgtggtcgacttctgccatgtgtccgatgagcatcagaaccttgttgctgtagccccactcattgtcataccaggaaacgagcttgacgaacttgtcggtcagagcgataccggccttcgcgtcaaagatggaggtatgcgggtcggtcaaaaagtccgaggaaacaaccgcgtcctcggtgtaatcgaggatgcccttcatcgttgtctcagaagcctttttgacggcggcgcagatctcgtcatacgtggcggatttagccaggttgaccgtcaggtcgacaacggaaacgtccagtgtcggaacgcggaacgccataccggtcagcttgccgttgagctcagggataaccttgccgacagccttcgcagcgccggtagaggaggggatgatgttccccgcagcggcgcggccgcctctccagtctttcttggacggaccgtcaaccgttttctgagtagcggtggttgagtgaaccgtcgtcatcaggccgtcaacgatgccgaaattgtcgttgatgaccttagccagaggcgccaggcagttggtggtgcagcttgcattggacacgatgttcatatcagtggtgtacttgtcctgattgacgcccatgacgaacatcggcgcatcggcggacggagcggagataacgaccttcttggcgccggcctggagatgggcggaagccttctcagtcgtggtgaaaacaccggtggactcgacgacatattcagcgccgcaggcagcccacgggatttcagacggattcatcttatcatagacggcgatctcttttccgttgacgacaagcttgccgtccttcgtgctgacctcaccgtcaaaacggccgtgcatcgaatcgtatttggtcatataaaccatataatcgggatcgatgaacggatcgttgattcccacaatctcaaatttctcgggctgtgcgaccgcggcgcggaacacaagcctgccgatgcggccaaaaccattaatgccaactttaattgccattggaaacaacctcctgtgtttttgatagttttatcataatacaaaatcggagaaactacaatagggaacttcgaaaaccttgtcaatttttaaacgattttccttattgtctgcaatccctctttttataaacgcgggattttatggaaaacgcccaaacctattgaaaatatggttgctctatactataattgggaatgaaatacatgtcgaattatgtcgaaaatggttctttctggcttcttaaattggctgccagatattggcctcgtataattctttgcaagggccaaaccatagagaacaaatccgccggaaagaaggtccgccatggacgggtgcgacgatcgtattttttttgaccagttcaccgcgttgtgcagagacgcccaattgcccgcagctctgatcgaccgcgatttcaatctgatttggcgcagccatgccgccggcgaggccctgccggccctgcgcctgcccgatggggcgcgtgtgctgctcaccggttacgcacccgaatttatctgcgagcaggtcggacaaaacggcttttttgtgacggccgcgcgccccgacctgcacctggagcggccggtgcgtgtcagtgcctttccccgcacgacagaccggtttcttttgacgccggccggctgcaatgcatccgaacttggcaccggtatgcgtccggagggcatctcccgcacgctttcctcattttcaaatcaataccgcgcgcccatgactgtcattttctccatgctgacactgctctcacgcgcctgtgggccgcaggccggcgcggaggaccttgcccattgcggcgagtatatcggcgccatcaatcaaagcgcctttcgcctgctgcgcagctgcaaatggatcaccgagcatatgcagctctcctatggattgtcgccgaaccgtccgagcagaaccaatctgtacggtcacctgcgcgagctgttcaccgcggcggccgcaatcatcgaaccggccggcatacccgtgacagcccgtatccctgacggcgttttgccggtggcgtgcgatacagaaaagcttggcctgatcatcggcaaccttctgtcgaacgcctgccgctttacgcgcccgggcaaccggatcaccgtgcgtgtgcggcgccagcaggaagctgtttttgtcacaatctcggatcgcggtcttggtattccggccgatatccagccgcgcgtttttgaagcgtatttttcctatgaccacggcggctccccgtttgccggaaacgggcttggacttaccatcgcgcgcagtgcggccgctcttatgggcggtacgctggcccttacctccacgccgggacgcggcaccaccgttatctgcaccatccccatcaacgattccagcaatgcgccgcccgctgttttcagcaccgcggccgactatgtttccaaccgcttttcgcttttgcgcgtcgctctgtcggacagcatcgactgcccgctatgagcgccataaaatgcgcctgtttcccgttgcaccaggaaacgggccttttcctatttgttagcatactatgcaggttgacatttcgtccccgccgttgtatcatcacagttatcagcggataaccaatgtcgcccagctatgaggctaatttgtcatcgaaggagaggacatgcatgctcgagcttttagaagatatcatagacctgttctggtggattgcgccgtttgtttttgtattcacactcctgcgtgcggtgcaggagacaatccgcggcggggaaaagaacgtcatatatggcgtggctgcggctgtcagcctgattgtcattgttatagccatcacctgagccgccttttgcgcaccggcgccggccggttttgtaattttaccggtaaatgtttacgatttctctgttcattggagcgctttcgtggtatactatattattatattttacgacatcaaacgcatacaaggaggctcccttcgatatgaatggaacaggaaagacgttttatatcaccacgccgatttattacccttccgataagctgcatatcgggcacagctactgcaccgtggccaccgacgttatggcgcgctacaagcggatgcaggggtttgatgtcatgtttttgaccggaacggatgagcatggccagaagatcgagcaaaaggcgcttgcggccggcgtcacgccgcaggcgtacgttgataaaattgtcgacggcatcaaggagctgtggaagctgctcaacatctcaaacgaccggttcgtgcgtacaacggatgactaccacgtcgaatcggtccagaaaatctttaaggacctgtacgataaaggctatatttacaaaggttcctataagggcaaatactgcacgccgtgcgaatcgttctggacggacagccagctggtcgatggcaagtgccccgactgcgggcgcgaagttgccgacgcagaggaggaagcttactttttcaagctgtcggctttcagcgaccgcatcctcaagctctatgaggacaacccccagtttatggagccgcagagccgcatgaacgagatgatcaacaacttcatcaagccggggcttgaggatctgtgcgtgtcgcgcacctcgttcaaatggggcatccctgtcacattcgaccccaagcatgtcgtctatgtctgggtagacgcgctgacaaactatatcaccgcgctcggctatggcaatggccgctaccatgattttgaaaaatactggcctgccgacgtgcattttgtcggcaaggaaatcatccggttccatacaatcatctggccggctatgctcatggcgcttgacctgccgcttccgaaaaaggtgttcggccacggctggctgctgcttgagggcggcaagatgtcaaaatccaagggtaatgtcgtcgatccggtcgtactggtggaccgttatggcgtcgacgccatccgttatttcctgctgcgcgagttcccattcggttcagacggcctgttttcaaacgaaagcctgatcacgcgcatcaatgccgaccttgccaacgatctgggcaaccttgtttcgcgttccgtcgccatggctgaaaaatattttggagacgctctgcccgcagagcgcaagtccgaaccgatcgacgatgagatcatctcgatcgccaaatcgcttaaggaaacgtatgaccgccatatggagtcctacgccttccagaacgcgctgatcgacatcttcaagctgatctcccgcaccaataaatacatcgatgaaacggcgccctgggtgctggcgaaggacgaggcaaaccggccgcgtctggcaaccgtgatttacaatctgctggaatgcgtgcgcatctgcgcaattctacttacgccgtttatgccggcgacctcgccgaagattttcgcgcagatcggagcgcctgcagcagtgacagcctatgaatccgccggaacctggggacttctgcccgcggatgtccatgttcataagggagagggcctgttcccgcgcatcgacgtagccaaggagcttgccgcgcttgagcagacaaagcaagctgcaagcaagggcgccgcgcccgctaaacaagcggcgccggaaaagcgcgccgaacccgagggcgtcgcctcgctgatcgcaatcgacgatttcgccaaggtacagatgcgtgtcgcgcaggtcctgtcatgcgaaccagtcaagcggaccgccaagctgctgcgcctcatgcttgacgacggcagcggtacgccgcgccaggtgctttccggcattcatccgtggtacgagcctgatgcgctgatcggcaaaaagctgattgtggtggccaacctcaagcccgccaagctgtgcggcgtcgaatcgaatggtatgatccttgccgccgacgcgggtgaaaacgacgtcagggtaatctttgtcgacgaaagcattccctgcggctctgttgtccgctgacggacgctttttgagggcttggatgatctgcccggcttaacaaactgtttctaacccgcggcgcagccggcaaaccaggtttgccggctgcgccgcggttctatgtccaagtgaaaggggactggtatatgtatcggaatatttttgatacccacgcgcattacgacgaccataaattcgacgatgaccgctgcgcgctgcttgacagtctgcccgaaaagggcgtctacggcgtggtcaacgccgcgagcgatcttgcgtcgagtgtaaagggaatggagcttacagcgcgctggccgtggctgtactgcgctgtgggcgtccatccgcacgaagcggacggatttcaggagagcgaccttgcaaagcttgccgaattcagccgcattgaaaaggttgtcgcaatcggagaaattgggcttgattaccattatgatttctcgccgcgcgatatacagcgcgcggtttttgaagcgcagacgcgtcttgcgtgcgatcttggtctgccagtcatcattcatgaccgcgaggcgcacgccgataccatggaggttctgcgcaaataccgcccagaggggattgtccattgtttctcgggaagcgccgaaatggcgatggaaatcgtgaagctcggtatgtatgtcgcgtttggcggcgcggtcacatttaaaaatgcgcggcgcgccgtacaggcggcggcagtcgtgccggacgaccgcctgcttgttgaaacagactgtccctacatggctccggagccattgcgcggaaggcgctgtgattcatcgatgatcgcgtatgttgccgagcgtctcgcggcaatccgcggcgttgacccgcaggctctgctggatcagacctgtgccaacgcacaggctgtatacaatctctgatatttctaaaatttattccaggatgtgataaaaaatgacgctttccgacgtgcaggcagcttttctggagcagattgatatcgatgagtcgtaccgcttcgcaaaggagcttgaacagtttaaatcaaatccggcgcttggataccgcacagccggttcacaagcggagtttgatgcgggcgagcatatccgcgccaggatgctggaaatcggcctgaccgatgtcaagaaagatgcctttacacttgacacctgggagttttcacatgcgcgcctgcgcgtcgagctgcccggcggcgcgcgcgtctttgaattgggcgcctatcagacagcatttgacacaaacggctggcggccgtttacgatgatctccgccggccgcggcactgccgccgaactcgatcagctcgatgtcgccggaaagcttgtactgattgagatcaatcagcgcgctgactggtggattgcctacccggcctatcaagcgcatctgcgcggtgcggctgctgtaatcgctgtgcaaagcggcggctacgcacaggcgcatccagcggcgctcaacgcacaaaatatctgcggtcccgccgacgcgcccgccttttccatgtcgcgcgctgacgccgggctgctggaggctgtgctcggcggcttcggcggcgaggcgcaggtacagttcgacgcgtgttcaacaatcgggcacggcggcgtttcatataatatcaccggctgcattgaaggcgaagaccgcacgtcgtacatccttctcagcgcgcactacgacagttattttaccggatttcaggacgacaatgccgccgtcgcgatgatgctcggcattgcggccgccctgatccgcatgggcttacggccccgccatacgcttgtgttctgtgcgtttgccgccgaggagtggggtgtgtgcgattccaaatacgactggtcaaccggcgcatacaaccaggtattccgcgtgcggccagactggcccggcaaaattcatgcggccctcaactttgagctgcctgcctgtgcgcatggtaggcaggctgtgattcgaggcgtctatgagtggatgccgtttcttgaagcgttcgctgcgtccttctcaaccgcatatcccggctgtgtcggcctgttcccggcagggattggcgcagccgcgccggtgctcacctggtcggatgatttttccctggcgatctccggcattccatcccttgtcaacgactttgctgaaggcagctttatggaatcgcattaccattcacagtttgacaatgacgacgcctatgatcccgcagtttaccgcttccatcatgcgctgtatggcgcgctgacgctcgcctttgacgcgcgcgctgtaccgcctcttgatttttctcctcgtcttgcggcgctgcgcaaaacgctcgatacgcagctctgcgcgcgcgttggcaccgatgcgcggccgcttttggaagcggccgccgatgccgaaaagcgcgcgcaagccgccgcgcgcgctgcgcgcggcgcccgctccccaaaagatgcgcgtgcactttccgccggccttttaaaagcgttccatctttgcgaggacgcgttcacgcggctggactggcatgacgcggtcatcttcccgcatgaatatgcacagacaaacctctctttcctgctcaaagcacgcgagtcgctgtgcgccggcgatacggctgctgcgtgcgacgcgctctgtgcagtcgactgcaatcggtatgcccttgccttcgacgacaaagtatgcgcccacttcaccgactacgcgcgtcagcagcccctggaccggctgatgtggggggctggacgcctgccgggggactgccggctgttcagtacagtgcgagcattaaaacgcccatgcagtgaagcggatatcgcggctgcgctcaacgctgtcgagcgcgcctatggcgagcagcgcgcggcgcttgtgcggtgtatcggcgaagaaaatgccgcctgccgcagattggccgaacttctaaagacacttcctggtttggagcgcgcctgatttccgagaatttgagagataatcgaagaaaacaggcgataatgaaaggacgcggtctgccggcaccggtggatcgcgtcctgctttatttctttcactgcaattatcgcacaaccaatttgcataaaacttgtacaaaatgctacaattttaacatccagaagcgcagttccatccggcaaaaacaacccggtatttcggggaaaaaccataggggtggaaatatgaactagcacttgctcaccatacgattacccattgaaataacaaaaggtgagtgaaattttgaaaaccgaccaattataccgcgtggagaaacaagatgttgaaaagctcagctccttgctgactgaatgctttcaacaggacccgctctatttgcaactgatcccacaggcggacaaacgcaaaaagcttctgccggagctttttagctgcgatctggatgaactgttcgaaaactgtgaaatctatgccgacagtccggatttaaacggtatcatcattgtctccgatgagacagagccgtataatccgctcaagtattatgctgtcgaactctattacgcgctgaaaagcggcatgtatctgatccgtgacgaccattcgctgcgtaccttttggaattttatccgcggcaaggattacctcaactctgtctggacaaataacctgcacaccgaccgccgcatgcacattgtctattttgcggtgcgcccggccatgcgaggccgcggcgtcgcgacaaagctgatgcacgctgttcagcaatatgccgatcagagaaaactgatggtttccctggagacgcacaatgaaaaaaacgtccgcatgtacgaacactatggttttcgcttgttcgaggttgtgcaaaagcacttcgcgctcaagcaatactgcatggtgcgggcataacggcaatctgtttaagagggagcgtcaaagaggcgggccgcaatgcggtccgcctcttttcatcatctcatttctacgcacccaggcacgcagcagcaatttcacgaaattccgcttcgtcgagcaggccgcgtttttcaaggccgcgcgccttgacacgcgcgagcatttcggcggcctgttcatccgtggcggtcatcccgcatcgctccaggtaatactgaatggacgcctttccgctttttttgccaagcgcgatctcgccggaacgcccaaacagcgccgggtcggtcgcaaacattgcgagcggacaactgcgcaccagatcgacgccgatgcctgactcgcgcatataattgcgcgcgccgacaaacggcttgttgggcgccgcggcgactcctgaaagcttttccaccaatgcgcacagctctcccaggcggtccagacggtaaggcgtatccatttccagaaggatattcatacaaaggatcatttcctccagcgcggcgttgccggtgcgttcgccaagcccattgacacaggtgtgcaccacgtccgcaccggccgcgatccccgccagctccccggcaacggccagtccgaaatcgttgtgcgtatgcacctcaaccggcagcccgtttgtcaggcgcttgacctcgcgcaccagatacgccacggcctgcggcagggcgcagcccatcgtatcgaccacaccaaccgaatcgggcggcgcgctctgcatcagccctgtcagcagtttttccagatcctctgcccgggcgcgcgtcgtatcatatgggaaatagacggctttaagcccctggctgcgcgcataattgatgcagtccacacttttttccaacacatgctcccaggtccagccaaactgatattttaattttggataaccgatggggatttcgatgacaacgcctttcacgcccgcatcgcgcgccatgtcgatatcctgggtttttgcgcgtgcaaacgcatacacctgcgcctgcgggaatctgtgcgcgatctcggtaatcgcccggcggtcctccgccgaaacggcaggcatccccgcttcgatgcgagtgacgccggcctcaaccagtttttcagcaatacgtaccttgtcctccgctgagaatacgacgcccggcgtctgttctccatcgcgcagcgttgcgtcgtggatctccacgtgaccagccggctgtgtctgttcgcggactggacctgtttcattaaaagggcttacccaccatgcattttctttataataagacaaattcatcagacctttccggcacgccgctggcggcgtacctgtctgcggccgtgttctcctccacactcagcaaagcctgacttcggatcggacgggatgttgcgcgggcatgcacatagactatttcgacagcttcgctgtcagcccttcgcccgcacggaatttgtgcttgcgcacatactgttccacagcgtcatattgcttttcctcaatcaggcgcagaatctcctcatgctcccgaagcgattcctccgtgctgtccggggccaccgcaaacactgtttttgtgatgccccatttcttccacaggtcgcagatcatgtgatataattcctgattcggcaggtggcggtacatctccagatgaaaggtccggttcaattccgaacagcgtttggcatcaccggcatagaacgcctctttcatttgctcgttcatttcccgcaggcgcgcgagaatttccggcgttatataatcgatgctcaatcgcgtcgcatatccctccaggacgcccttgatctgaaaaatatttttcagtgtctcccggtcaaagccacatacaacggcgccctggtttgcaacgatacgcacatagccctcgctctccaagcgccggactgcctcgcgcacgggaatgtcgctcacctgccactgctttgaaatctggctgatcacaaggcggtcgccctgttggtatgcaccttcggcgataccctccatcagcccttcatacacaatatctactttacttttatactgcgtcatcatcgcgcctcccacccgtttacaaatcttgccacggtatattctatattttatatcgtgttcgcgcaacttgcaagccgatttgtcggtcggcgcgcacagttttatacttcttccgtcagtggttcaaggtccagaaggcgcgccggatttgtcacgatcatcgcatgcaggtctgcatcactgatgccaaggcggcgaagcagataataaaatacgcgcatgccatccgccggcgccgggcttgccacctgcccatagtcggtaatcagcgccatatgctgtgcgcccacagcattgatcatgtccgcgatttcgtgcgggtcctggcggccattatgcggcgaacaggcgccgtaggccatcgtcagcgtcgcacccagagatgcaagctcccggcaaagctcaatcgaaaaaccgccctcccaatcgtttggatgcgtgatttccagcttcgtataaccgatgcggtgcgcctcacgcgccagcgccaggcactcgtccggcccaacatgcccgctgcccagaatcgcgccgtattccttgcagacggccatgatctggcagacctccggcttgagcgcgccgttttcatccagcacggtcagcggttccaccgtttccccgaacgcgcagccgcccacgtactctttaatccaatggccgcgcgccgccaaatccatcgcgtacttggcgtcggtcgtcggcagccagatcattttcccgccggctttgacacaggcggtgacgctgcgcacgctgagtccgccgcagggcgcgtttaaagcgatgccgccgaaaacggatacctccggaaccacctgggaagcctcatacgcttccccgacagttgaagccaggtgctttttgatgacgattgcgcgcattccagcggcggccgcctcgcgggcgaggcggatcgcatcggaatagcgcggcgagtagtccggacccacgtggacgtgcaggtcaatcgcgccttttaaaatcgtatcgtcgataaaagtcatgcatgttccccctctgccttatttgtgtttgtccgccttgcagccattctgttaagcgccaggcacccgatcagcagcgcaatgccgattatatctgtaacaagcccctcgtcgatcatcaaaatccctgagacaaagagcagtatgcgctgccacagggcaaagtcggtcttaaaatagccgacgaccgccagcgcgatggcaaaggtcccgataaagctcagaattaccgtcgtcacgatcgacacggcgctcccctccatcaaaaggcttgggctgaatacaaacatgaacggcagtacaaagctgacgattccatatcggaacgctgtccagcccacccggttcagatcggcgttggcaatgccggccgcgacataggacgccagcgccaccggcggcgtgatcgtggagatgcatccgaaaaagaacacgaacatatgcgccgcgatcagcggaatggacatattgacgagcgcaggtacgacgacggacgccagcaccagataggccgccgtcgtcggcaggcccatgccgagcacaatcgaagtcagcatcgtcaggatcagggcgatcagcgcgtttccgccggatacgctgacaataaacagggacagcttcgccccaagccccgtgatcgacagcacgccgacaatgatgcctgaagcggcgcaggcgatggccagggaacctgtgtcgagcgcgcctttcttgattgcgctgacaatcttttttcctacgtcaagcagcagaccgccgcttacgccgcgctgcttggcgatcatggccgccagatagacgacgattagcgccaggcttgaaaaatacgccgctttaaacggggagtacccgacaatcagcatggcgacgagtgtaatgatcggcaccaggtagtaccagccttcacgcagcaccgcgctcaggctttccttcgcctcgccctcctggtagatgtcaaaaccgcccttgcgcgcctcataagtacagatgatgacgagcgttgcgaaaaacagcagcgccgggatgatcgcagccttcataatgctcgcgtagctgtatcctgtgatctcagccatgatgaaggccgcagcgcccatcaccggcggcataatctgcgcgcccgtcgccgccaccgccgtaatcgcgcccgctttttcaggcgtatagccgcgtttttccatcatgggaatcgtcagggtcccggtgatggcgacattgcccgcggccgagccggagatcatgccgatgagcagattaaaaataattgccgtcttggctgtggccgccacaaatttctgtgtaacggcggttgaaagccgaaacaggaacgtgccggccccgaattcgctgagaaacgcaccgtagatgcagaacaggacaatgtatgtggccgacacgccgagcggcgtgccgtaaagcccctccgtcgttgtgaacaggaatccgaaaatgcgcgatacactgtaattacgtccctggaatacaccaggcagataggccgcgacaaacggatatgccagaaacaccgcgacaataatcgccagcgcgcacccaacagtgcggcgcgtcgcttcaatgacaaccaatacaagaatcacgcccataatgacatccgtgctgttggtcacacctccggaggtgctgatgctctcccagcggaacagcagatacacgctgcatacgacagcgcacagcgccagcgccgcacgcgtcaggccggcggccagcgtgggcgcggcctttttcccgcccagcagaacgattacaagcatcgccatcagatggatgacgcgcagcgtcagcgtcgacatcacaagcgtgcccgttacattgagcagatgtatgacgccgacaacgacggccaccacggcaaccagttttttgcccgcggctgtcagccggtcgtttaaggtatttgcggccataagctccccctcctttaccatcctttgaaggcctatttgtgctcgtcaaaatacttctgcgcgccgggatggatcgtgacgctcgcttcacgcgcagtctcaattgtcacatccttcgcgttcgcattggctgccgcaaattcgtccagatggtcaaaaatactggctgttatcgcataaacaagatcttcattcatatcggagcgcacgataaggacattgttgataccgatggcaacgccgtcctccttcatgccgtaagtatccgccggcacgacaaccttgttgaaataagggtcattttcaatgatggaatcaaatttatcctcatcgatgttgacaaatttgaccgcctttgtcgtcgagaactccataacagccgacgccggatagcctgcaagcgcaagcgccacatcgacatttccgtcggaaagctgtgtgaagccgtcggaatacgaaagataacttggcacgatgtcgtcgatggtcagcccgtacgccttcatagccgcctcaagcggggcgatggttccgccgccggacggtccgacagccacgcgcttacccttgagatcggcgatggaattgatcggtgaatcctccggaacaatgatatgcagcacgcttggataaagccgcgccaccacattcagatcggatttctctgtaaacgggtcggtaccgttgacggccgcgtatgcatgattttcatttgtcagcccgatgtcgacatccccggaggcgacaagacggcagttttcaaccgcgccgcccgtaacttcgggcgtcatcgtcaggccgccggaatattgtgtcaccagattggcaatcgcctgtccgaacggatagtaagcgccgcccatgctcgccgtccctatgctcaactgcccggacagcgtcccggaggcagcgcccgcggtgtccgcgccggctgttgaaccggtgttcgccgcgccgccgccctgtcccgcgttctggcagcctgccgtcatcagccccacggccaatacggccgaaagaagttttttcattctgcttttcatatcgttccccgctttctccttagtttgtttctcccatgcgaaggctttgccctcgtttttctatattatatattatatataatatatttcaagacatatttcacccaatcttacaattctttttttattcaatttttacaaatacttttaaaattatacatatccctttgttgggaaaatcacctgttcggatacatacaccacacggcccatgctccagacatgccggccggctgtgcgccgccgtacctcctccacatcgcaaagcgtgatcgcccggcccaagcaatgctgcgcgcacgccggcacaagcccctgtgcacgccgtaccgcgcacagatcgcacttctctgcccggcccgtatcggggcgcagataaacggcgccgaacgggcaggcgcgcacacaaagcccacacccgatacaaagtgcatcatcgatcagttgttcccctgccgcgccgcgcttgatcgctccacgcgggcacgccttggcacacgaggcgtcgctgcaatgctggcacatgacgggaatatagtcgcagctcggctctgcgcccggcccttcaaccgcctgaacctccacgccgcctggaccgggcggcgtctgatgcgcctgcttacaggcgacctggcatgccttacatccccaacagcggtcgatctccaccagaagcgtctgttccatcccttattcctcctccggcgcgggcgtcacgctgcaataatagccgcgcgcgcagacagttcccattccctgcgcaaagccatcccagggaacggttttattgatgttgtattctccccaccaacctgacacgccctgcacaacgccctgtgccatgccgaaagtaaagcgcgcgtacgcaaaggcgctgccggcggacgactgtacgcgcacgcgcataccatcggaaatcccaagctgttcagcagtggctgggttgatgtaaagatacgcgcgcggcgcaagctccagaaggtatggattctgcctgttttcagaaatacgaaaggccgattcatgacgtccggtcgacatcagcagcggatattgctcagacggccggccgctttcaaacggcggggtatagcgcggcaccggatcgcagccgttttgcttcgccaacgatgagtacagctcaatttttccggagggcgtctgaaaccccttttcccgatatgtttcatagcgaagcggcgcatacaaacggcggcgttttgcagcctcctggaaggtcacgccggccggtgcgagaagatcgtcgtaaagcgcgcgcgcatccttccagaaacggtcacccaggccgacacgccgcgccaattcacagatgatatccacatcgctgcgcgcctgcccgacagacgccgccttttgctggatcaatgtgtgtgtgttgttcgattgaaacgatgagatgacattgtcgcgttccagccaggcggacgccggaagcacaatatcagccatgcgtcccgtcggcgtcagaaacagatcggatactatcaaaaaatcgaggttttcaagcgccttttgcaccatatctgaattcgtatagctgacaaccgcgttgcttccaaaaatcattgcacatcgaatcggatatggttttcctgtggccatcgccctccacaacgacggcatatgcgcgctcggcaccggcgacagctcgccgcacagcaggggaaattcatcatacccgatgcgcagcctgcgcatcggctcgggcagctcgtccgaacagatgaaacgatgtgtattctggctgacctcgccgcgcgacgatacaagaatgttgccgcccggccggccgatatttccggtgatagatgcaagaatcgacgtcgcccggcagacctgtacgctgtcgtgcatctggtcgagcgcgaggccgcggatcagacaggctgatttcgcctgcgcataaacgcgagcggccagcacaattttttcagcgggaacgccggtcactttctccgcccaggccggcgtataggcccgcgtttgttctgcgacccggtcaaagccggccgtccattctcgaacaaacgggacgtccgtcagattttcggaaataatgacctgtatcatagcaagtgcaagcgccatatcggtgcccggacgcggctgcagccatagatccgccttggcagccgtttcggatagctgcggatcaataaccagcaaagcggcgccgcgcattcgcgcatccataatatcggcggcgcgcaccccccatgaggtggggggattgacgccccatgcaagaatgcaatgggtattggggaaatcaaacgcctccatatactgcgcgccgccaaacgtgaggttgcagtccacaaggcgcggccaaaggcactgcgcccacccggcagccccgtggttgggcgcgccgaacaaattgcaaaagcggctgtacacgcggctccagccgcgacgcgttccctccagaagcgcaaggctctgcgggccgtatcgatcgcgaaactccagaagcttgtccgcggtgatctcaagcgcctcgtcccaggaaatttcctcaaacttcccctcgccgcgcgcaccaacacgcctcagcggcatttttaaccgcgtcggattgtaaagcagatcgcgcgccgccaacccttttgcgcacaatatgccgcgtgtctgcggcgatgtcggatcgccttccacgcgtaaaacctcgcctgttttgctctcgctgtatacaagcgcctcgcacgtggaatggcaggaaaagcatacggtcggcgtgacggtttcgccgggctgcgcggtgtaggccggcaccgtctctgacataggagcagccggacttacggtatgccttcctgcaaggatctcatcgagtatctgcgcacgccgggtcggatcgcggccagccgacagatagtttgcaaatcgtgccctttttccgctcaatgatatctcctctttcttccgttgttattatatataatatattatatataataacaacggaagcgcaagcgtcactctgcataaaattagacggctttttttgtcaccgtccgctggcaaagcagccggccgcgctgctgcgcggccggccatacccatataccccctataaaataatacagatcagtcccgtgcagccctcgttgatgatgcgttcgatcgtctcctgaagtttcatgcgtgcgtcgcccggcatccggtaaagcttgttgtgcagcccctcgttgacaagctcatgcaggctctttccaaagatattgctttcccagatcttcttcggattttcctcaaactcccgcagcaggtacatgaccagctcctccgactgtttttcggagccgacgatcgggctgacctctgtcgtgatgtttgcggccatcatgtggatagacggggcggacgccttcaggcgcacgccgtaccggccgccctgcttgacgatctccggctcctcgagcgacagctcctcaagcgacggcatcacgataccgtagcccgtggccgcaacctcgtcgagcgcgcattttaccttgtcgtattcgcgcttgacggccgcaagttccaccatgcacggcatgagcgccgattcatccggaatttccagcccggtcgcctcaccgagaatgcggtagaacaaatcattttttacatcgacgctgacgctggccccgccgctgcccaggtcgatgttgtcaactagcacgcggctgacatactcgcattcggacagcgttgtgattttcgacttgagctggccgatgcgttcaacgtcctgagcggattgcctgatcgaatcgtacagagaggtgcgcagccaatggtcgggtgcaagcgaagtcacccatccgggcagcgacacggcgacctcgcgcaccggaaactggaacaggacgtcggaaagaatcacacggatgtccgcctcacccaggtcgaggcagttcactgcgacaaccggcacgccatagcgttcctcaagcgatgcgcgcagggaaacggccgccggcgccgacggatttgtacagttgagcaatacgacaaagggtttattgatctggcgcagctcattgacaacgcgctgttcggcctcctcgtattcctcacgcggaatatcgctgatgctgccgtccgttgtgacgaccaagccgattgtgctgtgttcattgatcaccttctgtgtgccgatttcagcggcaagattaaaagggatctccttgtcaaaccacggcgtcacaaccatgcgcggctgttcattttcaatatagccgagcgagcttgggacaatatagccgacacaatcgatcatgcgcacattgagcgttgcactgtcgtcaagcgaaatcttgacggcctcctcaggaatgaacttcggttctgtcgtcatgatcgtgcggccggccgccgactgcggcagttcatccgtcgcccgctcgcgggcaaattcgctcgtgatattcgggataacgagcgtttccataaaccgtttgataaaggtggattttccggtgcggaccggacccactactccaatatagacatcgccgccacagcgtttggcgatatccctataaatggcctgtgtctccattcgatttctcccctttcggtcgtttgccgctttatttcatcgggatcagcagcattttcctgccgtcgagcacgcctgtttccaattgattgcccgcctggatggcggccgtcgacgtattataccgttttgcgatctcccagatggattcatgctccgccgcatagtaaagatacaacatattgtcatgccgcggctttggacgcgattcatcaatcgcaacatcacagacgatctttttacggtactggctgtataaaccgccgcagatgcgcactggacagcggacctccagcttatcatgcccgttcatggaaaaggttgccgtccccgcgcagaccgacggggtaaatacgatcgtttcatattcctcccgcaatggaatgcggtggctgtattcgcgcacctggtcgtaataagcgacctcgccgcccgcttcgcatacaaacatgcagatggtcatctttcctgagacaacaacacattcctgctccacgcgcacccccggcgtgcctgccgcacaccagacatcgatgatgctttccacattcggcggcaaatcgagcgtctccttatacatacatgtttcgttcaccgcctcgagcaacttgagcagcggcaccggcttgatcgtcggcttacactcaaactgcgttgaatagcagtcgcacgccgcgtcgagctgcacgcgccggtgcgcgagcacgcaggcgttcattgaacattccagcgcaaacatacggttttcaccgtcgctgttggtctttggcgtgatttcgcatgtgcttacctcataccatgcgctgcatgcgcagtcctcctccagtccatcgatatccaccacctggctgaccggcaggctgtattccatcatctccggctttttggcgtcctcctcgcattgatagatgatccggaccgtcaattctccctttgtaaccagcttgcctgtcaaaattttgtaatccgtcagctccgccgaggcgtcaaagcggataatcccggcaatagccggcttgccataaccgagctcgacctcctcgcgcaaaacgatctggcgcgaagcctgtgggagaatgcgtgtattttccgccgtctccggacaaaattccagtccgccctcacacgcggagcagactgcctgttcctcgctctgtccgtatacacgcgccgcaatgctgacggcgccgcgcatatcgagccggcgtgcgctgaccgaacggcagttgaaataatcgacgctctggctgattgtgataaccgggttctgcggcgcggcgcgcagctcaataacgcgcgtataagggattttgtattccgcatgacgaagacagccgttctcatcgagataataaagatgcgccgcggccacgccgtcaatggacagccggtcaccgtttacactggcggcaagcagcgacggcgtcacttcgcagcgcaggatcttctgaatatccgggcagtaatccggcagcaggacatcgcactccaacggctgctccacggagccgtcataaaccgtttcattgacgctgaccgtttgtttttgcagattcaactccatagcatgaccctcaccttccgtttgctaccaccaatatatgtccacctttttctgaatatgcgcgcgcaatcgctccttgctttaacaaactgttaacaaagatcgacactttctgacttgactattttttcaaatatgctaaaatgatcaagttgtgatgcataatctaacaaatttgagaggaatctaaaacagaatgaataagcttacaaaaacaataggaattacccttcttgctggcctgatggccctttcccttgccgcctgcggtggcgacaagcccgctgcggataccacctcgccggccgcttccgcgccggcctcctccgaagccgccgacgcgtccgccccggcttcctctgacgccgccgcttctgacgccgtctcctctgaggccgccgccccggccggcgaggctatgactgaggaggaatatgccaacaaaatttccgagttgatgactggccttcaggaggaagcaactgctgtccagcagcttgatccctccgctgcggattataatgaaaagatgatcggacttgtcgacggcctgaacaatgcgtttaaggagattgccgctctgaccccgcccgaatcactggcgacaatgcatgacgcatttgtaagcgccagcggcaaaatggacgaggccaccacgctctttaaggaaggcctcgctatggacccggccgcagaagctgaagccatgcaggccaagctcactgaggcttcccagaagtacggcgaggcgcttcaggaattgcagtctgcattgatgaccatgggtactgaagccggtgcggcgacttcttccgaggctgccgcttctgagggcgctacttccgaggctgccgcttctgaatccgctgcctgagaatcttacatagagccgaccggcgcttgccgtaacgacgaaacggctctaagaatttccggcatcacaacaaaaacacccgggatctttgtcccgggtgtttctgttttttgtgcgccctgcgggcgcgctgcgtaccgctatgcggccggctccttgctgatcttaaaaaagaagcgcaggattggggaaaggaacttcgggcttttgatgacaacaatcttcataagcaaccaccttttctcaggccaacggcccgatattatcacagcagcagaatgcggacagccagcgcgacaagcatgatacccgccaggatcagcacaagcttgagcgatgtaaagactgcaagcacaatgccaagcccaaatcccgcacagcattgtgcccaacagttgcaatcaaggaatttctttttcatcccgctcaccttccgcctgttgactcggatacgccgggacggtccaaaaggccgcccgatgctcttaacccagtatacgcgcggcgctttttttggtgacagcaatgcggtccctgtaaaaagccgtccaaataccggcttttttacagggaccgcctgtttgttttttaaagatcatcggcgtcctgcacaggtacctccccgcgcgccataggacggcctgtatagcttccatttggatcggtacggcttggcgggatcgcgatcatatgctcaatgacgcgctggacgcgcagtttgtcacgcggcgaaagcgcgctgtcagcccgatcgttctttttcgccatcgctattcctccatttggcggccaaggaatgacgcgcccgcctggatcagcttgatctccgtttcggtagccggcgccgggctgtcccctgccaggaacatcaggcttccgcagacatcgcccgcagcaacaatcggcgcctgggcaagcgcatagcggtcgactccctcgaccggctgcatcttcttaccgtcggctgtgacagcgaagctgcgccgctgctccatcatctcctccagggcaggcgatacgcggcgttcgatcagctccttctttgggacgcccgcgacgctgatcacatggtcgcggtcacatacgatcacaggataaccggccgtcttgctgagtacctcggcatactgtccggcaaaggcggacagttccccgatcggactgtattttttaaaaattacctgtccatcgttatcagtatatatttccagtgggtcgccttcccggatgcgcatcgtccgacgaatttccttcgggataactacgcgcccaagatcatcgatccgtctcacaattcctgtggctttcacttcttattacctccaaaagcatgtttaggtttccttgaacaatcggaatattcctttgttcaaacaaatcctgatcgatatcagataaaaagattgggatgatgtatttgatacttttgacagtagatagtatccgcaaaatttcctttgctatgctgtgttttccattgattataatggaaatttttttggatactgtcagagcctgccggtggattttttatccggaggttatggaaagctcacatagctgaaaagggacgccaatccattggattggcgtccctttgtcatcgctgttattttgcagccttcaccgctttgcagcggaccaaaatcagtcaacgtacatgtgcataggccaagccagatactcaagctcatccagcttttcagcagtgatataaccggccggcgcatttagaattgtaggaatgcggttgacaaccgacgcgcaggtgtgcgcgggagtatccggctttttcagtgtgaacactgtatccggctcgcctttgatcgtccagtcgcacatatcgccgtcgtccggtccataaaccttgccgatgcactgcgtctcgatcacaacgccctggaacgtctcagtcgtcacaacggcgctcatgccgatgcagttgccctttggaattgtctcgcccgtcgtctcgcaccacaaatcctggtcatagaaatacggcacacacttttgactgttcgatttgatggtcaagcccagcttgttgcacagcgcctcgttggaattccagacatatgcgggctccagtgtggtcggatgcgcaatctgctcctcaaactgctccggcgtcaatccaacgccgtgcgccttggccagggcgagtccataatcctcaacgttgtagctgaccgcgccctcaatgcgatcaatgcgatgaacagcgccagcgacagttccgatccagttgacccagaaaatgtcctgcataccggtgccggcgattgtgcagccattttccttggccatcttgtcaagacggttggtgatagcggccgaggtcgtccatggataaatagcttcctcacaggtggtaataacgttgatgccgcgggacaggcatttttcaaaatgctgcaccatatcaggcataaagctgaacagtgtcacgaccgcaatatcggcgtcgcattcgtccagcacagcgtcggcgtcatttcgaatgggaacattgagcttaacacccagcccggcgtaatcgccaacatccattccgacaatagccggattgacgtcgatggcgccaacaatctccgcgcccttctcatagagataccgcagcgtatatttggacatctttccgcagccatattgcaccacgcggattttttcacgattgatcattgtaaaatccctcactttctgaatattcaagcgatgttgattgtgaattcagtgtaactgttgtagcaggtataaggtcaatccgcaaatctgccatttttttcacaatctttttgtgcaaaactctatgggcacctgaagccggagaaacatcttgcgttcatccggcagagaaatgggcatgtccgtaatcacttcgcacaggtagtccccgcttattatataatgctgcgcttcaatatattccagcaagcggtgcgcataatccttttctttatagaaatcatcacaatatatacaggcatagctggctgcaggaaaaatcgtaatcagctcggaagaaacaaattccggattgacaaatacaaatacctctgtggaataaaacaagcgtttatccagatatgtccggcgcagcacagtgccggcgttgcaaaaataaatctgaggcaaatcgtcctccaatagaccctttttcaactggcgcagaagggattcataggtgtcaaggtcgtgctcgtaaaaattgacgccggtatccagtacataggcctggcgcgccggcatgtattccaactgaagaacgccatccggcggagccgaacggtaaaaagccaggctttccagggtgcggcgcacagcacttctgcggcattggagcgcgcgcatttcctccataagctgccggtccctgtcgcgcaacgcccgttcaacgccttcaatatcacgtgtttttaactgctgtctaatttccttgaggctgatgccaagcgatttcatgtactgaatgacatccaactccacactctgtttgatatcataataacggtagccattttcttttcgtacacaagggcacagcagcccctcccggtcatacaggcgcagggtctgttccgacacatgatttaagcgcgccatttcccccactgtcagcagatgcatgaaatcaccctccttgtcatgttatagcaggtgtaaggtttttcataatttcatcataacacaaacccggttgatttgtcaggcataacaggccattttttacagattgtctggaatggctggaagccctcaaaattgcatcccctaggagtgattgagaagtataaaacttcatgtgcttccgacgcaccacaatcataagcaaaataggcgacgctcgaagttttgcgcatgtggagcgggaccgccacgcgctttaattccagagcgtgccgccaaaggcggcacatggccattttgttatgcatttgcatagcaaaaaaagacacggcagtcagaatgaatgccgtgtccaaatatagtaaagggatatgaaaggcctgtagagcgaccttgcaaccgtttgcgggcgggcacggccgatacgaatgaaacaccatgaaaaaacggtgatatgatatcggcacgccgacgcttgtcattaaaaagaaaatccgctataataaagaaataacgcccgctgaaaagcgcacagatataaaacggtgggggacagaaaccggccggcgggatgcaggccgatctctgtatgaaatcaaaggggatccatgattgatctaagggatctatagaccacaggtacaatcccccttaaccgtcctttcgctaatatatatcaattattcatattttatcgtattagataacaattgtcaagataattgttgttatatatcgaaatttgttctaaaaatcgtaaactcacacgatccaaaacgggtgaccgatatgcttgagagaatcaaagcgctttgtaagcattcatgtatcacgataaccgagctggagcgcaaagccggacttggtcgaagcaccatccgcttttgggacaatcatccgccagcggtcgataaggtggccaaggttgctcgttattttgatgtttctgttgattatctgattgggaacacggataatccgcagtcacacaagaatgccggagacgcaatgtatgattttatccgttccctggagctgctctcccgcgcaacctccgaggtccaggagcacttggatcatcttctcaactattccattgatgaaaaagattagttttattttatcgcattatataccgaatgtcaacaaaatttgcgttttttatttgaatttgaaggtgaatatttgcgtatgattgaccgtatcgccgccctttgtcagcagaaaaatatcagtatcacaaggctggaacgcgaagtcaaccttggcagaagcaccatccggtattgggacaaccatccgcccgcagtcgataaggttgccaaggttgcccggtatttcggcgtatccgttgattatctgatcggcaataccgacgatccgtattctcatcaatcagaacggtcaaaaatcgccgaggccctgaaggaagttcaggcctatatcggacaaaagcttgcgacgctcaatcagcaggatctggaataaaattggaatgctccgccgggacggttgtcccagcggagcattccgcttaactttttcaggggctgtctgaaagcagcaaagccgcctcggctttcgcaggctgttcccagccctccatacgccgtatagcctccagccgggccacgccgacacgggcagcgcctgcacacagcagcgatgagatttcatcaaagcttttaaccggtccgcttgctttcacggcggcctgttcgccgatcagctccatagccacacgcacatcgcccggatcggtacagcggcgcagtgcaatcccggccgcaccacagcgccgcaccgctgtcatcacctgctcaagctccgctgccgacagcgtcttgaaatcgatcagtatggacaggatgcgtccgccggactgggccagacgcgccagctcctccagcgcggcccgctctgaggccagcgcgcccgacttgaccgccgccagatcgagcgcgacctccaactcatccgctccggcctctatgcagtcctttacgagcgccgtgcgcgcccgcggcgtcagcgcgccccacggatgccccaccgccgcggtcaaaacggtcgggctgccgctcaacagccgccgtccaagcggcaaaaaatacggcgggagcgtcaccgccgccgcaccgagcatgcgtgcctgacggcacgcatgctctatttgtccctgtgtgcaaagcgcagacagaagctcgagcgaaacgactcccggcacggtggacgactccggccatcgctgcgcccggccgccgccaggtcctttgccgcgggcggcgcgcagcatctgctgctccaccacgcttacaatctcatgccgttccatggccgtgccctccctttctgccaaagcaacgcacacagcttttgacgttttaaaatttaaaaatagctttttatttcaccgtcaagacaaatgctgtccaaaatgccgcagattgtcatatccgcgatcacatgttttcccagaaagatggccgatgcgccgccgtctgtgcttacaagtaccacgtcgcccacgcctgcctgcgctgcgtcaaagacaacggcgttttcccctgtccggcgtcccgcgccgtccagaaaatcgacaatcatcagcttttgtcccgcatggcttgggtccttgaccgtggacacaatattgcctacaacctgcgcgacccgcacagaatcactccttcaaggcgggaaggatcgcctcgacctcgtcggccggcgacggaatcacatgcacgccatacacctcgccgacgcgcttggcggcggcagcgcccgcctccacagcggccttcaccgcgcccacatcgccgcggaccatcaccgtgacaagcccggaaccgatctgctccttgcccacaagcgtgacgtttgctgctttgaccatcgcgtcggccgcttcgatcgcgccaaccagcccacgtgtctcaaccataccaagcgctaatttcatttcaaacactccttaatttatatcatttggaatcgcgatatgacaggtatcgatgatcccggcaatcgacgcgtcggacggcaccagctcgcgccggaatacctgtgccgcatgttcggagccgatcagatagaccagatcgccctggccggcctggccggttgaatcggccgccacaatcatcctggtgcgtctgcccttttcaataagctgcaccaccagcagcgggatgtttttcagcccttctgttttgacggttgataccacccggccggtcacctcgccgatatacatacagccttactccttgacaggcagaatcgcctcgacatcctcgtgcggcgaagggatcacatgcacgccgtacaattcgcccacatttttcacggcggccgcccccgcttcaaccgcggctttcaccgcgcccacatcgccgcggaccatcaccgtgacaagcccggagccgatctgctccctgcccacgagcgtgacgtttgcagctttcaccatcgaatcggccgcctcgatcgcaccgatcaagccgcgtgtctcaaccataccgagtgctaatttcattgtcatatcctcctgttgttataaaatcggatgctgtccctatcatttccggcccttcatccgtccggcttttgaacttaatacaatgacctgatcatatcgggatgcggcgcggggatcacaacgctgtcattcatcagcccagccgtcccttcgacggcgcgcgcagcgtcgatcgcggcctgcacggaggcgatctcgccggtgagggcaatgaacgatttcccgccaagcccgcgcccgaggcgcacctccatcagccgcacgtcggcggccttggcggccgcatcggctgccagcacggccgcgcaaagcgaaaacacctctatcacacccaccgacgcgacccggccgatctccgtgcaggcgttgatcgcccggggcacctggggatggatattcgcgacaaacatgctgtccaccagtttttcaccgccggacagcttgccggcctcgacgctctcgcgcacggcggccgcctctccggtgacaagcacaatgtatttgcccgcgcaaaccggttgcgcggtgacaagctccacagcggccgccttgagcatggcgtcccccgcctgcacgccggccgggatgctggtcaactcaatcatacctaaagcgttcatacggtcgccttccttatctcaatatagctgtccgtcactgcggtcacggtaccggaaatgctcgcatgcattttcacacccagttttccgggggcgatatcggctatcagcgtgttcttgcgtaccttgtcccctacgccgaccaccgggacgcttggcgcccccacgcccatgcgcagcatgatacgcacctgcccggttgggagcagcttttccgacagcggcgcgtccacgtcgtagcgttccaggcccatccgtgcgatcaggcgtttaacgggcagctttttgtcgtcgatgctgcggtcagcgcgggtataaacctccttgcgcggcttgacgcccttctgcgcaagcatcgccttcatctgctgcatcgcctgagacggcttcagcccaaaattgcaggcgtagtatgtacacaccccgcagttgcaacaggaaaaaaccccgttcgcatcgccgagcaggtcggttccctgtgcgattgtccgcatcgccttgtgcggctggacgttcaggccaagggcgttgcgcgggcacatctgcgtgcacatggagcactgacagcaaaccgaccggatcagctgcatgttgagcgtctcctcgcgcagcttccacagcggatgatccaccggaaaagccaaaaagccgccggtcgtctttgtcaccgggacatccgggtcgtccaccacgcggcccatgcacgggccgccgataatatagcggcacggctcggccgtaccgccggccgcctcaagcagttcccggcaggagatgccgaccgggaccttgaacgtgcgcggcgtgcgcaccgcgccgccaacggtcacatacttttcaaccacctttttgcccgccgcggcgtccgccacattgagcagggtgctcgcgttgcagacgaccgcaccaacgtccagcggcaggccgccggtcggtacgacgcgtcccgtcacctcgtaaacgatctgctgttcgtcgcctgccggataatattcgcgcagcaggtgcaaccggagctgcccaaacggttcgatcgcggtgcccagagccttgaccgcgccttcatagtgctttttcagcgcgatgacgccctccttcgcgccggtctgctccatcactaggcgcagcccctccacgacctcggccgcataaagctccatcacctgttgatcgacccgcaaaagcggctcgcactccgcgccgttgacaatgacggccccggcctggcagttgatctttacatgcgtcgggaaccccgcgccgcccgcgcccaggattccggcgttcatcaccatttccttaacatccatatatgactacctcaactctgatctgtcacacgccgaaatcagctttcaccgctgacaaacttttcaaacacgcgcttgccgccgatgtccaccgagtcgatgatcgcggcgatcgtcaggtcggtcggcttgttcacagtcaactgcgtctggcgggaggagctgccgctgacgagcatgacgacctcgccctcgccggcgccgaccgcatcgatggcgaccatcggcgcgcccttctcctcccaggtttcaatatcgatcggcttgacgatcagcagcttcagcccggtcagggtttccgctttgtttgtgctgaccaccgtgccctttactcttgccaactgcatcggctcactcctcttagtaccgcagccgcacacccgtttcattcaaggcgtcccgggcggacggcgtgatgatcgcgccggggctgcaccaaaccgttttgtccacagtccgcgcggcctggcgcacggcttcctccgtcaccagcgtcagccgttcatgctgctgcacgcggtggtaattcactgtctccacattcatggaggccagcgtctcaagcgcatcggcgacctgcccaagcaggctgttgcggtgaaagcgcggcgggtcaaaatccagcagcagctccacttttttgccccacaggatcgcacggatgaccaggaaggccaaatccgtcccatcctctcccgcggcgatctcccgcaggagggcgacggacggcgccgccagggcgaccgtctctgcctgcgacgtcagcgcgagcaggcgttcacgtcccaattgttccggcggcagcgcgttttgcatcgtgccggaaaaatccgccataatccagccgccgtatcgctctgcaaggcatcggccaagctcctcggggaacgccgccggggcgggcaacaggacgatatgcgcgctgctgcggccctggccgccgttcctgcgcgccagccgccggtccacctcggcggcgacctgctcaatcaggctgtgcatctgttccctatccatatccgtaccgcctcaagctgaaaatcaaagcccctgccggcggaccgcctccactacaaggccctcgcaatatgtctttgcgatgatgcgggctacctcgccctcaacagcgtcaaccggatttgaaggtgtgcaggtatcctccatcgcatggcgggccagcagcgggatatcgtccatggaaaatccataacggtgcagcggacggataccgatgtcctcgctcagatcgcggacgcagtcggccgccgtttgggccgcctcctgagcgggcaggccgcggatatccgcccccagcgcggctgcgatatcgcccatgcgttccaaacaggccgggatgttatattccatcacacggggcaggatctgcgcgcaggcagcgccatgcgggatatggtactgcgcgccgagctgatgggcgatgctgtgccctagccccaggcccgcgtttgaaaaggcgagtcccgccatatattccgcccagcacatatcggtgcgggcctgcatgtcgcagccatcggccacagccctgcgcagcgacctgcccaccaggcggatggcttcaatcgccagcgcgtccgtgtagggcgtggcctcgcggcaggtatacgcctccacggcatgagtcagcgcgtccatgccggtcgcggctgtaagggaaggcggcatccccaccatcagggtcggatcgttaatggccagatacgccaggcagttcgggtccatcatgaccattttgacgtttttcacctcgtcggtgatcacatatgcgcatgtcacctcgctgccggtgcctgcggttgtgttgaccgccacgatgggcacgcccggccgcgccgacttgcgcacgccgcagtaatcctcaatgcggccgccattggcggccagaatgcttactgccttggccacgtcgatcggcgagccgccgccgatcgcgatgatgcagttacagccctgacgggtatactgttccatcgccttgttgacaacgccaaccgagggattcggctgcacgccgtcgtatgtccagtatcgaattccggcgcggtcaagcacatccgtaacctttttgacggtcccgatttttaccaaaccctggtcggttacaaccagagccgtcaccgtgccttccagcctgtgcaggaattgcggtatctccaaaatgctgttttccccgatcagtgtgtggcggggctgtaccagctcgaccacatgattctccatgctgtcactctcctttgccttgcccgaccgtgcgctttgcaggcgtctgcttcgtttataagcggatatttttccacaaaatcaaacaatttatcacatttacagtgtcattatatcacgaggaaaacgctctgcgcaaccgtctcaaggttgtcaaacctgtagaaattacatcgtattttttgtcatgcgtacatccggtccatgccgatgtccgattttgtccgttttattcgaaacctcactgcgcaataccggccattccgaaccaatgacgcttgagcggatagtcctctgtcagctgcgccgtccactgctcatacgtctgctcgcgcagccgttcctccacggcctgatcccgggccgcttcatcctggttgagcccaatgtaaaacaggataaaataccccgcgtctttataagcgacggtcccaacatccccatatgcgcgggcgggatccgtcagccatgcgcggttgccttcgttaagacgtgaaacaagcatcgtctgaagggtggcgccgtcgtccgcatacgtttgctgttcgtcagcggacgcataatcccgcgccatctgtgcgaaggaagcttcgtccgtcaccttcgaggcggcttcttcggcttgctcctggctggagcccgcgtaataaaaggaacggaaggtcgccatatcaaacgtttccggcgacgcctcgtaagccgcctgaatctccgactgatcaaaggtcaatcccgtcctgtacgcattccgataactctcggccagcttcaccgtttccacaaatttctgataggtatcaaggttgcagcccgcgccgacagtcgcggccagatagctgtccgcgtcggcatagccgtcgctctccgccatgctttttatcagggctgtctcctcctctaccgcagcctgatcctccggctgcagcgtccagcccgccttccgcgcctccgccgcaacggcataatcactctggatggccacgtcggcctgccccttgaccagatcgcgccagtcggacccggtcgcctcgtcgtagtaactttcgaggctttcgccgcctgtcatggagaatacagaggatatctccgcatacgccttgctgaaataacaactgtatgtagccgcgcttacctttatatcgccgaccgtcaccgctgtggcccatctggcgtaaaacccggtagcggccagcgccatagcgagcaccgcaagcaaagccgccgctgcggcgatgcatgccgcagtcaatcgaatacgccggcgccgctgcgccgtctgcacggccgctgcgcggccggcgggcgttgctgccggcacgccgccggttcggttttttctgctcataaaccgctccctttaccgcttagtgcgcgccatcacctggcgcacgatatccacgatatcctccatcgcgacagttcccgcgtccgccccggccggcggctgaccgccatgggtacactgcccgccgcattttttctgttccatacaggctggaacgccgtcttttccgacattttgacatactgggcggccgccggtactaatccccagccgtgtacgcgtgtcgacaagctgatcgatctgctcgcaggaaagctcgttggcctgtccaatgatgctgcctgtatacatagtcacaagcgcataatattcaagcgactccatgcggaaatacgcctgcatcgggtcctttccccaagtcagcgcaccgtggttggccagaaggacgccgttgtgcgttttacagaacggcgcgatcgaatccggcacctcctgcgtaccgggcgcagcatacggcgcgacgggcacctcgccgagctgcaccaccgcctccggcagaatagcccgtgagagcgggattcccgcaatcgcaaacgaagtggccaccggcggatgggcatgtaccacacttttcacctgcggattttcgcgatagacgcgcagatgcattttcaattcgctggacggctttgtgctgccgcgcaggatatttccgtccaaatcgaccttgacaagaatatcctccgtcatataccccttggaaacgccggtcggcgtcgtccacagctcgttgtcaccgaccttgcagctgatatttccgtcgttggccgccacaaaatttttgttgtacatccttcggccaacctccaaaatcagctgcttggcctcataatcgcccatatattcgcccatatttctcattttgattgaacctcccatgtttttcatgatccgtaccgccgtgcggcctgaacccaatgaatacctctgtacttattatccggggcagcgcgcgctttgtcaagaaatcgccgcctgctttgcatccggacgtctgcactacatggagttctgccgatccggataagcttatgttgcactttgcacgaaaacgtggtaatatgtccgtaaaagagttctcacagggaaaaggggattggcaatgcttgcgatcacacggcgcaacgccatcaaggagcagcttctcgaacgaaaaagcgttacaataaccgatctgtcaaaacgccttcatgtgacaaaggaaaccatccgcagggatctgcgcttgatggaggagcagggcgacctgatccgcacccacggcggcgcttacattctggacggcgtgcaaaacgacatcgacatctccatgcgtcaggtccttaaaaccaaggaaaaaaccctgattgcagaaaaatgcagccagcatatccaatccggcgactctatttttctcgacggctcgaccacctgctggtttgtcgcccggcagctggccaataaaaacctcacggttttaaccacgtccctgcaaattgcgaccatcctggcggcctcccccacgatcagtctcattctgatcggaggcgccttttccccaaaaagcatggcgttccttggcgacaacgcctgccgcgccctctcaaattactatgtcgataaagcctttatatcctgccggtctgtcagcatggaaaacgggctgacggatgtctccgaaggcgaggcggccatccaccggctgatcacacagcgcagcaaccgcacctatctggtggtggatcactccaaggtagggccgacctcctttgccttcgcctgcgggctggattcgatcgacgccatgatctgtgataagcccctgccccaagagtggcaagactatctgtctggaaaaaatattgcattttattgatgattgatattctgtaaaaagggagatgggctgatggtccatctccctttttcattgcgcctgcttatttgatgcccagcttttcaaacgccttgtcaaagggagcgtaagcaattcccttttctgtaatgatacctgtcaccaggctgtggtccgtcacgtcaaaggcgggattgttgaccttgacgccctccggcgccatacgtttggcataccacatctccgtgacctcctcggccggacgctcctcaatcacgatctcatcgccgcttttcagcgacatgtcgatcgtggaggacggcgcgcagacgtaaaacggaatgccatagtgcttggcgagaattgccacgccgctcgtgccaatcttgttggcaaagtcgccgttcgaagcgacgcggtcgcagccgacaaacacaatattgatcttgccgcgcttcatggtgatcgaagccatgttgtcgcagatcagcgtggtgtccacgcctgccgtctgcatctcaaaggcgctcaggcgcgcgccctggagcagcgggcgcgtctcgtcgcaaaacacatgcagatcgtcccaaccatgctcaagcgcgatataaaccggcgccagagcggtaccgtacttggccgtggcaagcgtgcctgcgttgcagtgggtcagaataccgtcgccgtggtgcagcagttcaaagcccaaattcccgatgctgcggctgatggcaatatcctcctcgcggatagcgtccgcctcctggcagagacgctccttcatctgcgcgaccgtcagcttatcgcggttctcctcgagcaccttctccatccggttgagcgcccaggagaggttgacggccgtcgggcgtgaggaatcgagataagctttcttctccttgaaattcttcacaaaagcgtccatatcgtccgtctcaagctgtgaagcgacgatatagatcccgtagccggcggccacgccgatggccggcgcgccgcgcacacgcagcgcatagatggcctcccaaatgtcctccgccttggagagcgtcagatatttgatctcccctggcagaagggtctggtcgaggatgatcatttcctttttattgtccgccaatacgacggtatcaagacttaacgcattcatttatgtatatcctccttctgacggccggctcacaggcaggcggcggcgtccttcaaaaccttcaggaaatcggcgccgctgtgcagcgcagcgcgctctttgatatatcgtttggcggccaggatgcagatgcgctcggcgcgcgtgcgcttcgcctcgtcggcaatggtggtcaaatccttgacgttcgccatgccgaccgtgcggcggatcaattcaaggcctgtaacagcggcggtgtcggacaggatcgtgccaagataataatccatatagccgggcgttttggccatgcggtcggtgacatgctccgtatagtatgccttcattttcgccattgtcagatcaaccacatcgacgatcacctgctcggcccatccgcagaatttgccgcgctctgccggttcggcaatttccgcgtcgccgttgcaccatgcaaagatgatatttgcgacaacgttgccgatatcatagcccatggggccatagaagcagaactccggatcgaacaccatggtggtgtcatcgttgatgaagatggagccagtgtgcaggtcgccgtgaatcaacgactgcgcgttgcacatgaagtccattttcagcttggcgacctccaaatggagcgccgcgtcgtcataaagctcctttttgacaaagtcggcgttgggcggatagacgttgttgcggtttgcgcagttgttatacggctcggtatagacaaggtcctccgtaatttcgcacagctcggggttgatgtatttcttttgaagctcctttttctccttgtggtccagcacgatgtcggtcgtccccatcagcgtattggccataaaagtggtgatctgctcggcgaacttcggatagatcttgtgctggagcatactcgtgcgcatgatcgcatgatcgctcaaatcctgcattccgcaggcgcacatcaccgtgtcataaaaataaatctctggcacataaccgggcgccagtttgccctgaagcagcagaatttcggattcaatgcggtttcggtcggtagaaatgtgcatgtcggccgatatgcgcagcgcctcgccggcctgcttgattatggcagaatggcccttgccatcccagacgcggaacacatagttcaggttgccgtcgccgatctccttgcactgcatggagttttcgtcccagtcgaaccgcgtcaccttttcaagggcgtactccttggcgtcgtttaggttcatcagaaaatagctgtcatactttttcattccgcaaaacctcctgtgtcgtcgattacgattccatacaaatgatctgctgatttccagtaggagcaattatgttattttttgtttttatttttgtttaatttgattttatctcttttttaaatatttgtcaattgaaaacggtcaaaaaacaacattttcaatataacacattttaatatcaataaagaaagaacgagccgccgccgaacaaagccgtgcggcggccccttcctgattgcaagagaaaaagcgaggttcaatcctctttcttggttgcgtaagcggcaatcaacgccagagccaagaccgcgcccttgacagccggcagcacatagtacgaaacgccaacctgggtaagcccgttttccagcgtgcagatcagcgcggcgccaatcatagtaccgatcgcgttgggcttttctgcgccccccacagagcgcccgacgaatacagcggccagcgacggcatcagatagttgtcgcagccggtgatctgcgcggcggagttgcgcgagcagacgaccatcgcgccgatggcgataaacaccgcggtcaccattccggcgatgaagcggtatttcttaacgttgatacctgagagcttcgcggccgtcttgttgccgcccatcgcgtagagataacggccgtgcttggtgtagttgaggaaaataaacgcaaaaagcacgcatgccagcatgatcaggatgcaccagggagcgcgtccgatgttcaaaaagccttcggtccagcctttgcggatgggttccgctttccatggcgtcggcataccggaggaaaccgcgccgccgcccgtccaccagagtccaaggccctggtgcacgaacatcagggagcaggtcgccagcatatcggggattttgcagaccaggattaaaaacatggtcagcagatacataaccattgtaaacacaatcgtcgccaggatactggcccacaacggcaggccgaaccacagaaacgtactcgcgaacacataggcagagaaggacgccagggtgcaggcggacatatcaaatccgtccggcgccatggtcacggttgcggcgatggcaaaaatagtggtaatggccatggcccttaaaatattaatcgcattggctgcggagaaaaacgcgccgccctggatgactgtgaaaataacgatagaaaccacaagcgcgataacggcggcccagtccatcagaaaacggccggcgcttttctttttgagcaattgattcatatgtatttccccctgaatgagtggatttatgccgcagcccaatcaactggccacgaaagcttccgttccgccgaccgcgtagtgcatgatctcatcctcacacgtttcggctgtcttaagctccgccatgatcctgccgtcaaacatgacataggtccggtcggtaatggaaagaatctcggagttttcacacgatgcatagagcacacagttgccctgcttagcaatctcattgatcaacttaaagatttcagccttcgcgccgacgtcgacgcctttggtcggctcgtcaaagatataaatatcgcagtcggccgcaagccatttcccgacgaccaccttctgctgattgccgccggacaggttgcgcaccatctgaaaaatggacggcgtcttgatgccgagcgactcgacaaactgcttggcgttggccgccgttttgttcctgttgataaacgacagccggcaaaacttgctcaggcacgcggccgacaggttgaaatcgaccgtctcgttgacaagcacgccctccttgcggcgctcctcaggcaccagcgccatacgattgcgcaccgcgtcggacgggttcttgatcttgagctgcctgccgcccatggtaatcgtgccggcggattttttcattgcgccgaacagcgtcttgcaaagctcgctcttgcccgcgccgaccagaccggcgacgccgacaatctcgccgcggcggacatacagcgacacatcgttgaccttgccctccgtatcggagagatgatccacctcaaacgccttttcgccgatgtccacaatctccttggggaagttctcctcaaacgagcggccgagcatcttttccacgatttcctttgtggtcgtttccggcgtgatgggggagttgtccacgatctcgccgttgcgcataacggtgtacgaatcgcagatctgcagcacctcgtgcaaacggtgggaaataaagataaccgcaagattttctgtctcgaccaggtgcttgcagagccggaacagctcctctgtctccgtatcgctcaagggcgcggtcggctcgtcaagaatcaaaaagttgcaggagctttggatcgcgcgggcgatcagaaccatctgcttttgcgccagtgaaagcgttccgaccagacggctcacatcgaggttgatgttcaggcgcttgagcacttctctcgcctcgctgcggattttcccccagttcatgaactgcccatgccccatgttcataaccatgtggttaaacatgacgttttccgcgacggacagcgaggggatcagcgccatatcgacctcctgataaacgatctggatgccaagcgcctttgcggaggccggcttgcgcagctctaccacctcgccgttatacagcacgtctccggtgtaatcagggtttgaaccggccaacaccttcatcagcgtcgactttccggcgccgttggcgccaagcaccgcatgaattttgcctgtttcaatttcaaaatccacgtttgacagtgccttgacgccgggaaaaacaatggaaacattcctggttccaagcgtaattttatccatagattccctcttttccagtttatggtttccccgccggctggcagtgaaaaaccgcgtgcagcgccgcgcagcgcgcggcttttcacaatcagccgatgggaaaagcgttaagcagggcgtcggggggaacccccgacgcccgcttcgttacacgtaacgctcagagcagtcgttcttcccagagatccgctcctttattttggatcagtcccccagcagggcggccatccagtcggtggtgggcatccaggaacgatcgctgtagccttcgcccgcaaccgtatccaggttcatcacgttgattccgccgccggacaccatatcctgggtcacgactgtggtcggcagctcgagccaatcgctggccgtgccagtcatcgggtcgataatcttatcgtactcgccggccatttccagggccagaacgcgcataccgaattcgccgttatagtaccagttggtggtggcgcaggccttccacggggaattagccgcggccatcttgtcgatatcggcgttgctgatgtcaacgctgaccattgggatgtcgaagttgccctgggtcagagcggtatacacgccgctggcgtacaggtcatagcaacaccagatcgcatcgatgtcgcccggctggtatttggccagcgtggcggtcgtaacgtcggtcatggaagcctcggcgttgttgaaatcggacgggccgattgtctcaaccgtctggataagtccttcctgctcgtacttctcatagccgacctggcggcggtcaaacggcgaattgaagttcgggccaacccaaaccttcagaaccttgacaggctcgccggctgcgaccttatcaggatacagggtattgcagatgtagtcgagcagcagctcggcaaactgggcatcctgctggaagaactgggtcacgccctcgatcttctgggtttcgccgttgctgtccttaaacggggtgtcgaaggttgcgatcttcagatcgggatactgtttgagcagatcggtcagaaatgtgtaagcgtagttctgaccgccgtggctgagcagcaggccgtcatagccgccggaagcgcactgggaaacagtatcctgccaagtggtatccgaaccgttgcagaagaacgcctgatactccatgccgagacccaccgcggttttctccgcgtactcggaccacatctggaaaatgtcggaaggcgccatctgcatgatataggcaaccttcttgccggccacaggcgaggcgcttgtgtcgccggagggcgcgctggcggccggcgcgctggccgcaggtgtgctggcatcgccagccggggcggtgtctgccgccggggtgcttgcagtgctggccgtgttgttggagccgccgcatccggcaactgtcaaaagcattgcaagagccatcatcaaagcaataatctttttcattgtatcctcctattaatctttctcctggggggccgcttactgctcccctgtgttatctccaatttaacacagcctgtttggtttgtaaacgaatttgttgtattttttttgttttttggttattccaccaaattgcttaaattctttttgtcaatattaaccatctgtttttaattagaaagcttggaattagtaaaaagagatattctattgcgcaatatatttaaaaattctgttttatatgttgataaaactacctgtccacgtgccaagcaaagcccctgctttcccatcccctaatttatccattttattttcccagagttgattcagtcaaaatcaaacattttgcaacataaaatgaagtgtgcgctttatgccttttcttgcctacccatgttttgcatccgtctgccaacaccttcttttcgtcattttatcctattttttctgttgtttttctctttttgcttttgtcctttttcttgacattttttgaattaaattctatgataaaatacatacaaagcatttattttatccctgacggccaatcttatcatgccgcgctgctgacatgataaaatgtatctgaaggcatgccgctgacgtctgaaaatgggcgtccccttcccgcgcgggcggggcggcgtatcaaacaaggaggaatttcatcacatgaaaaagatcatcaatgctcctgaacagtacaccgacgatatgctcaagggaatctatgccgcgcatagcgacgcggtcaaatatgcggacggcgatctgcgctgttactgcacggcaaaaaagaaagacggcaaggtcgccatcatcaccggcggcggcaccggccatttgccgctgtttctcggttatgtcggcgaaaatctgctcgacggctgcggcgtcggcggcgtgttccagtcgccttctgccgaacagatcttcaacgtgtcaaaagaggtagaagcaggagccggcatcctctatttatacggcaactacaccggcgacatcatgaattttgacatggctgcggaaatgtgtgaaatggaggatatcgaaacgcgttccattgtgggcgccgacgatgtcaactccaacgccaatcccgacacgcggcgcggtgtggcaggtatcttctttatgtataaatgcgcaggcgccaaggctgcccagatgggcacgctcgacgaggtgctcgccgcagcgcagaaggccaaggacaacacccgcaccgtcggcttcgcgctcaccccctgcatcattccggaggtggggcatcccaatttcacgctcggtgaaaacgaaatggccatgggcatgggcatccacggcgagcctggcgtctggaacggtccgctcaagacagccgacgaaatcgccgccgaatcgctcgacacgctgcttgaggatatgccgctgtccgccggtgaggaggtctgtctgctgatcaatgggctgggcgccacctctgtcgaggagctttatatcctcagcggcagcgtcacccgcatcctgaaggaaaagggcgtctccatctaccgcacctttgtcggcgagtacgccacctccatggagatggccggcgcctccatttcgatctgccgtatggccgatcaagagatgaaggagcagattgacatgccggtgaatacgccgttctactgtcagaaatgaggaggctttaaaatgactgtgatcacctgtgagcagcttcccgagctgttcgccgcggtcggcggcctgttcacggaaaaacgcgacgagctgtgtgaaatggacgctcagatgggcgacggcgacttggggctgactatgagtaagggttacggtgccctgccgcagcttttgcgcgacaatatggagcctggcgacatcggcaaaacgctgatgaagggcggcatgaaaatgtcctccgtcgtcccctccaccatgggcacgctgatgtcctccggcatcatggccggcggcaaggcgctcaagggcaagccggagcttgacgctgccggcctggcggcctatattgccgccttcgcagacggcattcagcagcgcggcaaatgccagcgcggcaaccgtaccattctcgacgcgctcgccgccgctgcggacaaggcgtccgcccttgtgtccgcacatcctgaatcttccttgcaggatgtgatcaacgccgctgtcgagggcgccggcgagggtgtggaggctaccaagtccatgacgcctgtattcggcaaagcggctgttttcgctgcaaaggcgattggtacgcccgatcaaggcgctgtggcgggccggtatatgctcatcggaatgcaaaactatatttgccagtagcctgcgcatccccttttaccttaaatgaattgaaaaaatggccgctgtggggctttccgcagcggccgctttttgtgcagcgaaaagtgctgctgccgcggtaagcttaatcaatgcaaaaggttatatggataaaaattttgagtacatgcaggaaaacatcacagagcgcacactttatatgtgggtttttatccccccgggtcctgcccgccgaaagggcggcggtcattcttttttaaggcgcggctttgtcaaccgctccggaatgtgttatgatggtaaacagcggccggtgcggccggctgactggagggcttttttgatgggtacaaaagaataccgaatgaaaaaaatggaatactatggccgcccgatgggtgcgttaaacctatatatgtatctgctgctgcctgcattcgttctgtacagcgcggttatgttcgtttggcgtgcgacagtcacaagcgcacagttcgcctcgccggcggaatttttgaccaatctgatcctgttgatccttgcgaccgcggcgcttgtttctgtttacggagcggatcggtacgcctttttcagcaacgtcttattcctgccggttctggccgtgtggcgggtcttgtccaccttttcaccgtctctgtttgaaccggccgccggggcggctgcgggcgcgccatcctctgcccagacggccatcgacagcgtcatccagaatatttcaatgattacacagggcgttcagacattcgcggccggtctgccggagggcttgcaggcggcggcttcccgggcgcttgaaatcctttccagcgcctcgatggggagcggtatggggatgatgggcggcagcatgggcgatataggcataggtatgatggatgcgggtatgatgggcatggacgcgggcatgatgggcgtggacggcatggctggcgaaggtgcggctgccggcggttccctggttgcaaagctcgttggtttgttcgtcaaaaccggcgacgacatcacgctctttgtcagtacgattgaatgcggattgtttgttcttttgtgtctgtttttctttttcttttttatcaagcacgccaaattttttctcacgccccttgatcggttccgcgccagagatgaattggcttaattcccaggctgttctactttttcgccaatacccgggccgcacggcgcgggtatttttatatatttttacaatcactccatttttcaattgaaattcataaaaaatattatagttaatttaaatattttttaattaaattataatttaaatttatttatatattccaaacaggcggaaggcacataaatttttaccatgttttatttttatccggcgatgcgttattctaatttcagacattccagggcctgattgaaaacaaagtaattgccggattgttcgcagacaggtatgagaatacaatgcaaaaatcaggaatcctttcggattccgaggctttttaacgcggcattcgccgctatttgcagaaaaaacggtaatttcgatctttcagatagcccttaaaaaaggagcgattgcatgcgtgttccaaaggtcgccgcaatcaatgatctgtccggccttggcaggtgttctctgacagctgcgattcccattctgtcggcgatgggggttcaggcttgtccgctgccgacagcggttctcagcaatcaaaccggttttgagagcttcgcctcgattgacctttcaaagcagatttcccgcttttcccatgaatggcgtaaacgcggcgtgatcttcgatggaatctacacaggctttctcaatggtcccgtgcaggccggacaaattgcagattggatcgatcaatttcgcactccgcagacgcatgtgctcgtcgatcccgtactcggcgaccgcgggcatatctatcctgtatttgatcacgccatggtcacggcgacgcgcgcactgatcgcaaaggcggatatcatcacccccaacctgacggaagcatgtatcctggccggtgtcggctatgaagaagcaatgcgttccgacggactggaggccgttcgtttagcggcctgcgcgctgcgggaacagggaccgtccaccgttgttatcacaggcatcccgcgcggcgaacagattgtcaacgctgtattttccccgcaaggcgagcatttgatcgcgacgcggcgcctgggcgacggcttttccgggaccggcgatattctggcgtctgtgctgtgcggcggcctggtccgcaaaatgaagccgcaagccgcgctggatttggctgctgccttgctccaaaaggcaattgcccatacgtttgccgaaggtaccgatccaaatgacggcgttgcgtttgaaccatatctgtatttattaactgacagggaggcttatcaatgaatcgtcatacaaccagcgtcacaccctcagggcggctgttgacctcagccgcgatgttcgcggccatgattacattaaccacagcatatctgtttcacatcccgattggtgcgaatggcggttatatccattttggcgacgctttcatctatctggccgcgagcctgctgccgatgccgtatgcctgtgcagccgctgcgatcggcgggggcttggccgattttttatccggcgtgccaatctgggtgatccccacaatgatcatcaagccgttgacggctgtctggttcacttcgcacagtgaacggctgctttgccggcggaatgtctgcgcgctgattttggcaggtcttgtttccaatgcgggctattacattgcggaggccctgttttccggcaactggctcgctcctctggcgctccagtggggcggcgtcgtgcagtccgcaggcagtgccgtgctgttcctgctggccgccgccgcagccgaccgcctgggattgaaaaaacagctttttcgaacacaagcttaaagcttgtttgaaaatatagcaatgccgaaattttcgtaaacagcaggagaatgctgaaatccttaaagatgaaaattttgattgtccaaacagcctatgagttctgacaaaatcgttgttttgcagctttatcttgcacatctgtccactttgcgggcaggcgtattctcatcaaaagcaatggaggaaaacgcagcatggaggatattctttatacatacggcaaaaatttatatgtgaatctaacgaaccgctgcccctgcaactgcaccttttgcatccgttcccaaaagcaggggcttggttccgcagaaacgctctggcttgatcatgacccctccgccgacgaagtgatcgccgcattccaggcttatcgccttgaggtctttgaggaattgattttctgcggctacggcgagccattttgcgcactcgacaatatgcttgcggtctgccggtatatacgttctgtcagcgatatcaaaattcgtgtcaataccaacggccttggcgacctgatcaacggccgcgaaacgccgccgctgctgactggactggtcgatacagtatctgtcagcctgaacgcaccggacgcacagtcgtatttagaggtgacacgtccatctttcggtatacaatcgtttgatgctatggttgatttcgccgcacgctgcaaagccgcttcactcaatacagttttttcaatcgtcgatgtgctgccagccgaggaaattgaagcgtgcaagcgcctgtcggaacaaacaaaaattccgcttcggatccgtcatttttccggaaaagatgcatagctcaaagcagggggagaagactataaggcttctccccctttcctttttccaccgtcatcccaccaaataaagccgcgccagccccaaaagcggaagatgcgcccgataaaacagataaaaaaccgcataagcgcacaggaacctgcacttgtcgctgccagcccatacagacaacggggaatcgtcactatgcggccggcgcctgtatctgttccataacaggatcacagcagccggttcgaaggagcaggatgcggaatatacactgattttacggaacgcttcctcaaattgtccataaaagcacaatttttctaatcgctccaaaagcgtatattttcaattggcatttatctgcaaattaccttgtatgtcaatttgcacgtcatttcatacgattattccactgcacatcacatcgctgctgtcatatcatgaatcaggagggttctgcgcgcacccgcatatttctgtgggcttttccctgtgcgccgcccttatcgctttggaaaaggagaatttggcatatggaatgcaagctcaataccgagacggttgtgattgcggtgcaggattgccccgacaacatgccggctcttggcatgacgtattcgccgtggcagcagtggacctctgtttatgaagcggatgtcggcttttgccgtggaacaatcttccctgaactcgacaaacctttcttagagggggcgtgtccttgtgtgtgaacgtcagaaattgttaaggcaaatccaaatacacaattttgccatcaccgatgtcgtcctctacctcgatggtcatccgacctgccagccggctctcgcatattatgagaaacataaacaactgcgcgacgaggcggtggccctttataaccaacggtttggcccgctgaacatgcgtgaaaacacaaacccgaacagatggacctgggtcgatgatccgtggccctgggaattggaggcgtaaggcgatatgtggttatatgaaaagaaactggagtatccggttaagattaaaaatcccaacccggcgctcgcaaaatttattatctcccaggtcggcggtccggacggagaattcggcgccgcgacccgctaccttcagcagcgttacagcatgccgtatgcgcaggtcaaggggatcctgaccgatatcggtacagaggaactggcgcatatcgaaatggtgtccgcaatcattcatcagctcacccgctgcctcacccctgagcagattaaacgcagcggcttcgacacctattttgtcgaccacggtaccggcgtttacccgcaggctgcggccggcgtaccgttttccacctctgtactgcaggtcacaggcgacacatacgccgatctctatgaggatcttgcagcagaacagaaagcccgcaaaacgtatgacaatatcctgcgccttgcggatgaccccgatgtacgcgatccaatcaaattcctgcgtgagcgtgaaatcgtacacttccagcgtttcggcgacgcgctgcgcatcacccaggaaaatacgaatgcaaagaacttctatgcgttcaaccctagctttgataaagcctgcaatccgcccgataagctgttctcgccgccgtgtactgcggctggagaggctggggctgttgtcagcgcggctgaatcggcctgtgcgcctacagcctgccgcggccgtacaccagcaaacacccgcaaccggtgcgccgcccccacctgtggacgtacaaacacggcacaggcgaacacctgcggacgcgccgcccccgcctgtggctgtgcggcagtagttgcggataactgccagcccgcacctgcctgcggttgtgaggctgcaaagcctgaacctgcctgcggctgttcggatacggcgccggccgccgcgccggttttccaatcgtgcgagccggagccgatcggctttaaaagctgcggctgcgccccgatagctgccccatatgtagtgcccaagcgcagcaaacacagcgactgcggctgcggctgacggtcctgcctgcccaaccaagcaaaaagagcctttgcaagcagcaaaggctcttttcagttattaatttataacgcttattccgctgtatggcctactgattcaagaagcgcgttggcaagcgtctccagctcgaccgctttgtcagcatgcagcgacgaggccatcgaaagccgctcattgagaacggtcatgtttttcatctcctcatcgatgaacttctgcatcaaatcacccgatttgcatgcccaggaaccattttcaatcagggcaaaagtcctgttttgcaggttcagcgccttcatatcgatcaggaagttgtgcataaccggataaatacccagattatacgtcacagaagccagcacaatgtggctgtacttaaacgcctcggagatcagtgtggagacatgcgtattggagacatcgtaaagggcgacattggtcaggcctttgtcgcacagccgggcggccaatgcctgcgcagcgtcctcagtatttccgtacatggaagcatacgcgatcaggacgccctgctcctccggcgcgtaacggctccagtgatcgtatttatcgatcagataggccaggttgctgcgccagaccggaccgtgcaggggacagaccaccttgatcttgtccaggatgccgccggcttttttcaaaagcaattggacatgcggcccatacttgccgacaatgttggtaaaatagcggcgggcgtcgtcgagccagtcgcggtcgaaatcaacctcgtcgttaaagagctttccatcaagcgcgccgaacgaaccgaacgcgtcggcggaaaagagaacgccgtttgtcaggtcaaacgtcaccatcgcctcgggccaatgcaccatcggcgcggccacgaaggtgacggtatgcttgccaaagcactgcgtatcgccctctttgacctcgatcagttcatgatcgtcgatcctgaaaccaaactgccgcatcagcatgaacgccttctccgtgctgatcaccttgacttttggccagcgcagcaggatttcctcgatggacgcgccgtggtccggctccatatgattgatcagcagataatcgagcgggcggccgtcgagcaggtgctcgacattttcaaggagctggcggcaggccgaccaatcgacggtgtcaaaaagcacggtgctttcgtcgagcagcagataggcgttatatgaaacaccgcgcgggatgggatggatattttcaaacagatggagccggtggtcgtttgctccgacccagtaaagatcctctgtcacattacggacgcaatacataattgattcctccttatgatggcggcgcacagattcttacgcctcgataaactgctccttaccttccgcgcattccggacagacccaatcctccggcagcttttcaaagagcgttcccggcgccgcgtcgctgtctgggtcgccaaattcaggattgtattcgtagccgcatccgccgcagacatacgttttgccaatgggggcgggcttgggcggggtcggacgcttcatcttaaccatcgggggcgcgggctgcttctcgccccggtcaagcgcggcagtcagcagcggcagaatttctgtcagatcgcccacgatcccgtagtcgcagtttttaaagatcggtgcattagcgtttttattgatcgctacaattgtcgaagcgtccttaatccccttgaggtgctgtgtggcgcccgagataccgcaggctatgtaaaggttccctgtaaatttctggccggacattccaacataacggccaagcggaacatacttgagtgtctccgcgaccggacgggacgaaccaattgccgcgcccgcctgagcggccagcgcctcaatcagcttcatgtttttcttgtcgccgatgcccttgcccgccgaaacgacacgttccgcctgagcgatgggggtatcgagcgggatgccgaccgtgaaatcatggccgtccttttcgagcgccgctacaagcgccgcaacccgttcggaggcgtcgccctccttaaagatcatcgtcttgcgcagacccgtgaccggcgcgggctttttgcgcagcttgccgccgtcggaggactccttcggaggcttcccgagcagatgcgaggcgatgaccacgcgctggatttcgtttgtaccctcataaatggttgtgatcttcgcgtcgcgataagcgcgttcgacctccatacccttgagatagccgctgccgccgaaaatctgcagcgcgtcgtttgtaacctccagcgcgatatcggaggcgtacatcttggccatcgccgattccatgccataggggacatggtgctccttcagctcggccgagctgtagatgagcatacgcgcgcagcgcagcttggtggccatgtctgcgatcttgaaggaaagcgcctgctggaaggcgatcggcttgccgaactggatgcgttccttggcgtattcgaccgcatgctcaaacgcgccctgcgcgatgccgagcgcctgggccgcgatgccgatgcgtccgccgtcgagtgtcgccatcgcgattttaaagccttccccttctttgccgagcaggttttccttggggaccttgacatcgttgaagatcagctccgcagtgctggaggagcggatgcccatcttgtcgtaatgatcgccgaaggtgaagccttcccagcccttttccacgatgaaggccgagatgccgcgtgtgccgatgtcgggcgtcgtcacggcgaaaacgacatagatatccgacttgggcgcgttggtaataaagatcttgctgccgttgagaagataataatcgcccttgagcaccgcggtcgtttccgtgccgcccgcgtccgaaccggcgttctgctctgtcaggccaaatgacccgagcttttcaccgcgcgccagtgggacaagatacttctgcttctgctcctctgttccaaaggcgaaaatcggccaggaaccgagcgaaacatgtgcggagaggatgacgcccgtaccgccgtcgacacgggaaagctcctcaaccgcgatggcgtagcttaaggcgtcaagccccgcgccgccgtactccttgggatatgggatgcccatcagccccatttcgccaaagtgcttgatctgctcgtcgggaaactcattgttttggtccatgacaaaggcaatcggtttgatttcattttccgcaaactcccttacctttgcacgcagcgcctcatgcgcctgggtggtttgaaacaacatgggatcgtcctcctttatcttgcgcaatttcgtgctttgatcatgtggatacaaacggcccgccgcatacaggactattttcatccactttttagctgaaaaacagcgccggacaccgtctcatcctggttttccggagagaatggacgccaggctgtgcgattgcaattcacggtctaccgcctgctggatcgactcaagctgcgcgtggatgccgcatttgccgccgcaacgctcccgccagaggcattgatagcccggcgccatgcaggcattgacaaattcaacggaatccatggcgaataaaaggtcatagagggtcttttcccgcagatcgaccgccagccggcatcctccatcggcgcctctggtgattgaaacgaagctcgcctttgacagcttgcgcataatcttatatgcgaacggctgcgggattagttcccgctgacagagctgcgccgcgctcacctgttccccctcggacaacgcccgtaaaatgcgcagcgcataatcgacctcccgtgtgatcagcaggtttcatccctccctgtggatatcatctttttaatggttccactctaccattctggataaaaaatgtcaagaatccagacacgatccttactatttttggaggatcatccaggaaatcagtgggaattttgtgcagaaaagcacccattcttcataagtttctgcgttgccggcttaactatttttgcatgaccagttcccagagggccttttccagcctgagaaaagccctctgttccgcctgcgtcctgccgcgttcgtttccttgcctgcagcaatgcggctctcatccgtccggtttgcaatcgagcggcagagcgacgctgtatgtaaaataaccgtcctccagagaagccgtctgtatccctccatacttctccacaatctgcgtgacgactgtcagcccatgcccatgcagcaccgtgtcccgcttcgcggtccgccccggcaaatccccatgggccgtattgcggataatcacagaaaagcttcggtttgcgcactgaatgcccacccggagcgcacgggccatccccgccggcatccgctcacacgcctcaaccgcgttatccaacagattgcccatcagactgcatagatcaacatcctcatatggcagctcggacggcacacaggccacctcctgctgtatatcgatattaagcgcgcgcgcacgcgccagcttgaccgtcaaaatggcattgagcagcctgtgcggcgcgtatacctgcaaaacatccgccgtttcgccgcagagctgttccaaaagacgggccagcttctccgtttcgccctgtgtctgataaaaccgcagcagtccataattttgctgcacctcatggttcctgcgcgccgtcgtttccaggtagcgggccaacagatcggcctcctccttctggaccgccaacgccgactgcgcggccaggccctcccgccagacacggagattttccccgattaaaatccccgcaatgacaaaaatcagcacaagaccaccccattccgcgggccagccagtgacagccggctcgtaaagcggcgcggctgcacgcgcaagcagtgcgcacccaaatacgcctgtcccacagagcagggcgcgcgcctgctgatttccccgccatgcgtccgctacgcatagaacgatcaaataaacggccgcggcccactgatagagatgcaaaagcacactgtaaaggcgcatggccaccgcatcccacgcgccgggcagcagcggaaagcctgtcaccagtgcgcataccgccatcccgaccgaaaaagcagcggtacgtatgcgcagcggcgctttgcagagctgtccagcgaccaccgtaagcgcgaacagcatcccatacaggcttaatttttcaaaaagataccaccaccctccggtgatccccaccgcatgcgccacagggtatccggcatagccaaaataacacaggcaaagcagcgcgaagccggccgaacctgcccgtctgccctgccgcagtccaagcagcagacaggaaccgcccacaagcagcgcggcggcgatagccgcgctgtgcagcgccaggcgaagggatcgcagcaatccaacggcctttggtgttccaaaggccggcgggtagatcagcccgctataaaagctgtcaaaattgctgaccgcgatgacaagctcgactgcgccttctgcccggatcgcgaccggcgcgtctgcaatagcagggctgtaccgctccgggtccggctcgcctgacgagtagtacgcttcaccgtttacccacaggcggcaggcggagtatgcctccggcatttcaagcagccagtcatgcccgccttctgtcaggatggtcagccggtaggttgcgctgccgcacggatcggcggcaggatcatcaagctcatatccgccgtactgtccaagataaagcacccgatcgggcgacaacccgtccagttcgtccggtgtgtgatagccgcggtaaaattcccatccgtcaaccagaaagaacagcggatatctctgccggtcgcccggattcatcttgagcaccccctggcggccgcgcgggccgggccagttgtatttattatcgtaccggcagagcagtaaaaatccggcgagactgcatgccaacagcgcacaaagcagcatggcgaatggaatgcgtcgctttttcaaggctttggcctcccctttcgccggcaaatccagcggtaaaacgcgccgcctgcagccgctgcggagcaaaacagcagggcgattggcaatatggcgcttaagccgccgcccgattcccttacactgtcttgagccgacagggcttttaaagcctcagagccgctttgtacctgcggatgggaggagacgggtgcggacacaccagactcgccggcttgcagcccgccggcaaagcccggcgggctgcaagccggatcacgagcgtgatccggctctgctgatgcagactgcagcgtttgcgcctggctggaagcaagctctgctgcgggaagcgcttgtgaagccgcaggcgctctgtcagccgattcagtcagacgtatgccgttcaaatctgaaccgtcggccccactgtcctccgatggacgcgcggggcggtcgccccggtgactgtcatcccggtcgccgctgagcgacctgctttgcggcaggccattttctccgaccgaaacctctatcagatttgtccgcaagacctggccgtccatattcacatccacctgaaaccaataggttctcccattctccaaccgccggtccaatgcgatggcaccggtattctcaacaggcgtccactctccccaggctgtccagctttcaccgctgtcctcagagcagtagacctgtcctgtccatccccccggcatggggccgtacaattcaagaatatcccgctcagtatggacgtcatgataagcgcgccgcaggtagggcagtccctcctccaccaccgtcagggtaatctccgcctccgggcaggcgagcggcactccttcaaagggaggccgcggcgttacagcaacctgataaatgcccggctgtgtgatatcctgcccgccgctctgccaatccacagacagttcggcaaactccatcggaatatcctccgcgttctccgctgacagcacataaggcagggtttccagcaggatcggatcctccccatatgcaaggcggaacagcggaaaaataatcgcctcccgatcgagacgggccgtgcgttcgatcacccgggcatgttccggcaccggagaaatgccggtcgcatcgattgtcagcatcccgcccgccgtgactgcgccctctatcacagaaagatacagccggatatcgcccgcggcttcgaccgcctttgcgccgccttccgtcctgatattggccatattcagaaacagatcgcctttggatcggaccgccaccgcgcccggcccttttgcggtcacagagccgtaattcggtgaaaatcccgcctggtctggattttcgggcgaatccccctccaattcgacggcgcagccgttcgtaacctccaacgccgcatccacattgagcttgagcagcccgcctgtctggacggtaaacatcggcgcgccgccgtctccgataaaccggtagtttccgacaggagcaaacatttttctttttgggataaggatattatgaccgcccatatacagcgtcctgcttccgcccccggatgccggaaacccgccgccgggccagaccacgtcgccggtcagcgtatattccggttcatcgctttccagccagccgagcagtcccgcgagcgcctcggcgtcgccctgcggcatgtcgcctgtgggcggcggcttttgaattcctcccagatttgcagaaggaaggtcatacgcccccgaatccagcactgccgcagggctggacgccgctataccagccacagaggacgcttcttccgctgcgggccgctcctgcgcccgtaccggcgccaatatggaaggaagcagcagaagcgccgtcaacaaagccgccattttgcggacacatcgtttttttatgggttggctcaaggatatctccccttcaatggttctcaggagcaggctgctttttccacagtctgtaataaacagccgaaaattgccgaatatacattggcgccgcctgaattccattataacgctttcaaagcaaaacggccacccctgtcaaaaaattctcctgtgcgggggattttttcttcgcttgctcgtatataaaccaaaagccgtcaggcatcaggaggctattcatgtatttgctccgtttgtcgcagcctcagttatctgcgtttctcccatatatcccgtcttacctgcatccatccctgctttcaaagggctgcgaggcggtcggatgcgtttcgcagagtggtctgctctgcgcggccgctgttgtggaaacgccctttacaggtgaaaacgaatggcggttaagctggttttttgtcgatgaaaaaatgcgggagcagggcgtaggttctctcctgctggcgggcgcgcagaagcttgccgccgaaggcggagccagtacgctgcgcatccgcttcactttgccctttgcgcagtcggatgcatttgaaaactttttacaccgacacggcttttacaccaccggcacgaccgccgtcacctaccgttccacagtcggggaggtgcgccgttccgcctatctgccccgtctggagcggatggcggcaagcaggcttcaggttcttgccttgaccgctctgaccgatgcgcaggccgacctgattgacgaatcgatgaataccctggacagccctatgagcagcctgcttctggacgacgccaccctcctgaacgcttctgtcgccgccttttgcggtgaaacgctcgtcggctgtctgctgatgcgggaggaaggcggcgagcttgagctttccgactgcataacggtcaaacgtgaccttggcgttctggcggcgatggcaagccgtgcccttgcgcttgcccttccagggcgtccggcggagcagccgatgcgcatcaccgcaatcaactccaccgccgagggcatgatcaggcactttatctccggcatttcaaccgagatggagcgtgaaaaaacaatgctctgccatttttccaaaacggcagaaatacctttccgggaggcgaacagaaatgtatgaatccgatcggcggcgtgcagcgccgctcacctccctgtacatgcagcggacaccggcggcgcgtgccgtgtccccacgcatggcccgcacagacgccatccagcggccggtcgagccgcccaacccgccgattgttgaaagcgcgcagcctgttctcccgcttggcggcgcgccgatccaggcccgaatctcccctggctccaagccggagcgcatcgcgcgccgccgggcgcagcgcgccgcgcagccggctgtaccggacggcgaagcgattgccgctatggagtatgaagtgaatcatccgatcgccccgccgcccgaacctgccttcggcgaggatgaaaacaacccgccgcctgaagccgcttttggggaaaacgagaacaatccgcagcttgaaccagaggctgttggccccgcgccggccccgcgccggccgggcttctgggaccgggaatatgcggaaggctcggtgctcggcggcatccagtccttccgcaaccgttacctttcactggaaggggcggcacgggaagagtaccgcgacgatatcgcccactttatcggccgcgttcccacccgcgacgaagtgcgggacaaccgcgcgcgcggcgtcacaggcttcgacgcgcatcgccatccgcttttgcggcggatgggcgcgcgggcgctgcgttcaaacgccgctacacgccttttcaacagccgttggtttacaggggcgcactgacaatatccaaatatccttgaagggagccgtacaggatgcaaagctatgtacaacgcgctaaaaaacaagctgcttctccggacattatccaggcagtccgttcttcgggcagaccccgcgccatccccgagcctatccgggaaaaaatgggcgcttcgctcggtatggatttttcctctgtaaagatctatgaaagcccgctggtcggcgaacagggggcgcaggccgccgcgatgggcaatgagatcgcgttcgcgcccggcaaatttaatatgggttccttttccgggcaggcgctgcttggccacgagctggcgcatatcgggcagcaggcgcgcggcgaggtttccggcggtgggctggtccgaaacagctccttcgagcatcaggccgacgtgcagggcatgatggccgcgcgcggcgaaaccgccgtctcaccggcatctagtgcgcagatcgcgccgatgagcgccgctcccattcaggcgcgcgagtccaaaagcgaacgcaaggcccgcagccggcaggtcagcgcatggaaagccggtatgcagcaacaatacgaacaggagggggcgctttgggcggcgcgcgccaacgccgatccgaccaatcagagcgcccgttatcgtgcgagttccttcgatccggcggcaaaaaagaccaccggcgagatggccgacaccctggctaaagtagacccgatttcattggggatcaagacacggaccgacgccttcaaagccgcccaccccggctatacgatcggcggcaccaccaaccgcgacatggtgcgttttcttacctcccatgcccagcgcgaccatgcgattgccaccggagatgaaaccatgggggtcagcgatcaacagatggaggccgccctgcaggcggaaaacgccaccagcaaggctcttgccgaccttaatcgcgcaaagagcgcaggaaacgccgaggaggaggcgcggctgtcgcagcatgccgccgccagcggcatgccgctggtgggaatggtgagccagtcggtcgctgaccttcaagctgagatggcccagttggaaggggcgcacaacaagcccatcctttccaccgacgacgccgccatgcgctatgcgcaaacttcggagctttataagaaggcgcagatcacccgcgatatcgccagcctgctgaacaagaccggaaccgcacaggcgctgcccgaggaacaggctcgtcagtttgaggcgcagtaccactacgcccaggatatctgtgaatatgtcaaggccctcttgggctatgccaacagcgggcagaggagcaaagagggcgacaggagccaaaaagcgatctttgaggaaaatgaatcaaatctgggaggcaagggcaacgcgaacttcgccaatttcatggcgggacaagcggcggcgcgccgccgcgccgccggcaattgaccggcctccatacggcataaagagccgcccctcctgaacaggaggggcggctcttttccgttcagtcgaaggcaaggtcggcatattcccgcagatcctcccggacgacgacgatctcatttttacgcaactcccccaccgccgaccggacaaggtgcctcatacagatcggcgcatcctcctcagcggcaagaaacgccgcgtgcaggacaatgtttttaatcccgccgcctgacaccttgaaccgttcggccagaaaggcaaagtcgacgtcgtccgcgacgggggcagccgccggcagcattccatggtaaaggcattcgcgcatctccttctccgggaagggaaagtgcacaacaaacccgatgcgccgcataaatgccggatcaatattctggagcaggttggtcgccataatggtgacgccgtcgtgatcctccacctgctggagctgataggcggtttccatattggcgtttcggtcatttgaatccttgacttccgaagcgcgctttccaaacagagcgtcgcactcgtcaaaaaacaggatactgttcgatttgcgcgcctcggtaaaaacctcccgcaaattcttttccgtttcgccgatgtatttgctcaccacctgcgaaatctgaatcttgtaaagctccatgtgaagctgattagcaatcacctgtgcgcccattgtttttccggttccgggcggccctgcaaaaagcatggaaacgccgcggccatactgcacacggcccccaaagccccattgaccatagaccttgtagctttgacgtacatgcgcacaagcttccctgagcagccgcacctgtccgggcggcaggatgagatcgtcccaatcataagccggccgcaccttcgcggccaatgcatccagacgatgaaccgcctgcccatagcagcagcggtggatctcctccgctccaatcatccggcgcgcagattcagccgcagcgcccttggcctgtcttacggcattgtaaatctgcatgggggtaaaccggaattttgccgaaagctcccgcgtatcgattcccggtcccagtgtccagccatccagaaaagcgtcaaacagggctgcgcgctcctcctgggtcgtttcgggcagctcgtaagtgaatatcacccgccggtttgaaagcccacaggcccggtaattgttttccgtcagcaaaaagacaggcgcgcatctatccggcagattgccgaccgcctcctcaaaaaccgattccaacggcttttccggcgtatccaacgcctccccatgcagaaagcaggggcaggccccggcaagcaaggccgcagcagccgtgtaacgcaccattccgggaatatcatccaagccgtcgcgcaaatctgcaaaaagcgcgccctgcccagcctgtgcaagggcgtggcggcatatcaggcgtttaccgctgccggattctccccggatcaccagtattccggccgctccgcaggccatgcggcccaatttttcggccgcctccccacgaattaccaacggttcacgcggctcacaggccgccaaatgcgtcatccccggcgcaagccggaacgcgctgccaatcagataatccattacaaacgggcgcagttccaaatcggcgttttcccatccgcgcggttcaaacagggtggaaaacagcccgccagcccgaaagcttgccatactgcctgcgatcaattcaccgggctttgtaaaaagctgacagcacaatgccatcccgggcagcttgcgcgccgcgtcgtcctgcaggtaggaaaacagcttttcatacttcgcatcagttgctgctacaaagccaagcagtacgcagtcccgctcaaaccggctcagtcccagcgtctgcgccagagagagggccggcagcacgccgcctgtacaatcgatgcggttttccaccaacgtgctggccgcctcgatatcgcgcagttcctcgtccgacacaccttgaaacgcctgttcctgtgcgccgcgggcaagattatattcgaattcctcgcgggataccacaagccccatcatattttggagcctgttttccggcccaagccacgcatgattttgatagacaaggtagatgcgccaatcaagcagagccttccagtcctccagaaaggacttctgatccatgtacggtttccccgcatttataaaatcaaggctcataaccgctcctttccggcctttttgaaaaaacgcctcggcgaaaaactttagtcggctgcgcccccgcttttttgaaaaaaagctcggcaaaaaactttaggcggcggcgccgcgaacagtggggtgggcgctgcgtttttttgcaggctgtgtttcaatcggtgtatacgaagtttctaataaattttttcacaggagataagcagttcaaatggaagctgaatatttagcgcacgcgccgcctgttgattggcaacgatatacggtgtgcatgtgtagggctgcatgatatcccccggctgttctccgcaaagcacccgtaccgtcacatccgcgacgagctgcccgatctcctcgtcgacaaggctttcctgcataatcaggccgcccgcctcgaccaatggttcgccggtctgaatgaaaacggggacgcccgcttcatgaaacctttggatgaacgcctgagctcgctgctgtggttggatgagctgcgtcgtcagcatgaacgcgtcaatgccttcctgttccagcagctcatcgcaggcggcctccaatccggcccaataagaggcaagcgccgtcccgtcgtccacgccgtcggacacgggcggcggatcgatccgccgttccacaagctcgattcctatctgcgcagccgcctcccgataacctgtacggccgccaaggccctcgtcataatagatcagccccagctttttaaagggaatcaggtcgtgatagagcacaagctgacgctgataccgctccgggtcggtataagcccaaacattgggaattcccgaatattgctcccccttcacaatcccgctgccgacagcgtccgcaagcggaaaagccagcaccggcacccgatcgcgcgcgtacagcttgccaagctgcgctgcctctgtgccaagtgtcacaatgatatcagcctcgccggcgttcacatacgcctgaaccgcctgactcacagcctgctgtccatcggctgcaatatcatagatctttcctccgcaaacctccagataaggacccaattcacaaccgtcgaacagtccgtcatactgtacagcctgaccgtcctccagcggattttccaatatccagccgttctgtttcagtccacgcagataacaatcggcgacagacacggtggcgtcgaacgaaattgccaccatcagtaccctgtacggcttcccgttctcccgcggcgccggtgtgcggaccactctttccttttcgacagattccagcgcgagccaggacggcgcaatctgtgatttctgcgaagccggagcacagccgttcaaaaacggcaggagtacggcgcagagcaaagccgtcattcgtattcgcagcctcatgccatcaccttcttttttccacagcgccgtatggcggccggggccaatccggcagccaggcaaacggccgtgcagcatccaagcgtaacgccggccgttgccgccgccctggctgcgtagccccgtgtgcgccggctgacatattcggaggaatgctgcccgtatatcatcgcgttctgatcgctgtaaagtgtgcggatcacctcaatgtttccttccgttttgcgcaggtagctgttgagatcggtgaggctgtccggctgcgctcccttggcgatcacgctgttcacctcctcctggatggtctggacaacctgatgggcgctgcgccgggccatcgattctgtccgccatccggcctgcacggtttccaatcccaagtcaaccgcctgtgccgccaggataaacacacaaaccaaaacacaaaaccgaagcgcagcgcgggggcggcgcttctcctttgcacgcataatcacaagtgcaacaatcgaggcagcctccagccaaattaccaacgactgcaacgctgccgattgcttttcctgttcaacctcagtgttaagggcggcgcggttgagcctcagcagcatccagcccgcaaacccttcccgtccctcgatatccagccaaagccacgcctcatctgccgtgtccagacttccatacagtccgtccgcctctggcagcgacgcagggtccaaaatccgcccgtcaaaccggcccgcctgtccgcacaactttccatccgcggacaccacacagaccccctccatgtaggaggaggtctgacgcagccgctccagcaggctgtccatattataatatgcctccaactgtttgccgtaacggagggcatattcaatccggctcacatactgcccggcggaaaaggcaagctgtaagcggttattttcggcgtagacagcgtcgatcgtcgtccgcttaaccgagagggtgcacagcatcccgatcaaaaacacgatcagcaccatcaggatcgccaacccctttttaactctatggcccatcagtcacgctccttttgcagcaatcctttatgggacattcacagtggaggcgggactcatcgtcacgctgatcaccccgccataggcgcacatcagcttggaggtgttgttaagcgccggcttaccgcccaccagtacggtcggagaaccgggcgcccatacgccggccgggacaggcgtacacggcattggcgtcagaacgcccagtgcggccgccgttgcactggcgaccgttggatttgccatggatgaacacatcccaaaggtggcaagcgtcacatcggaaatggtcgccaccggcatattgaccgccaatgcctgctgctggctcgtcgccatgagcgggcacggcgcgacgccgaacgtgcagctgcacatcgcgccgtttacgacaggcatcgccatttaaccacctccttcaaagagcgaaggtctgttcgccgctggccgcgtcgacagcaaaccgccggtatgtcccatccgcctcaagataaagctccgcctgcgccgtccccatcagcgcggcaaaaaagcggccgtccgcccccgtctggtaacggcgtaccggatagagcgcggtcccgcgcttgtgcgcagccctcagcggcgctgccagtaaaaacagcccgtcgcgttcctccataagcatcaccgtctcgctgcttttgccatccggcaaaaagaattcccccggcaccgcctgcatcagatttcttgaggaaaggaacaggcgcagccgctcccgtccggcctcgacaccatcctccgcaagcttgatctgcccgcgtccgggctgtatcagcagcgcctcccgccctgccgcgggcgtgcctgagacaagcaccgttccgtaaaatcggaccgctgcgccgccaaacggataatcttccgcgggattgagttcccggtaatattccaaaaagcctgtgccatccggcaggacggctgtccattccaatggacaaaagcccggtccgtccacgcgcactgtgtattcccctggaggcagatcgatcaaaacgaaccatccgcccggcttatagagcggcttcacggcctgcccattgagccagaagcgcactgccgccgcgctcgcgaccggttggccgcgaaagccgtctgtcagccgcagtaccagagaagctctatgtgtcaccgtgcatccctccccgcactcttttcatcgagtgtaacgctgatttgtccgacacgtccggctgtacgggtcctggtagattcgattgagacggtgcagttcaccgcgaaggacgccttatatggcttggaattggaattccacatgcgctggagcgcctccatcgtcagcttcgagattgagacgagcagcgcctccccgctttgtgcgagcgaaccgctcaacaccccgctgtcaatggcaggattgtcgcgcagcgcctgtacggcccgtccaaggatacggtattcgtcctccgcgcggtttgtgaccggcgctttggagtgggcggtgaccagatatgtcagcttgagctgtaaaggagccatccgctgcgtattgcgtccttcctgtataaatccctgccggccctccgcgctttcctccaaatgcagcagatggaccgtgagctgaaagtcctccggctcaaatgggctgcccaaaccgatcagttccggcttgctcaccggctccggcgtcatttcccggcgcagcagcgccacaatggcctgtcccgcctccgcgatcgccgtataaccagccatatccgattccccctttatgcgccgcggcagaaaccgcggctttatcaacaggccggtttatgccttctgtttcgacgccggttttaaccggctttgtttttcttccgatacccgggacgaagcctcatcgtcctgcgtattgtccgccgtttccccatcgtccgccggctgctcggccggcgccggcatctgctcatgtgaacgcagcgccagaaataccatcggcacctttggaagctgttcccgcgcaggatcggatgaatcctctatttcggaggacgcctgcgtttgctcagatgctccgccttcagaatcctcatcggacggctgcgcctgctgcgcagcgtccggatttgtccagccccaagcggttgcggtatattcatcatactcgaaccagcgggactggtcgggcgctttggccgaggcagcgatcgcgtcagccgcgccgccaagcatctgtgaaagcccttgcccgctggcaaaaaccggcagcgccaacagctccgatccggtcgaaacaggttcgtccagcgtgccaaactgctccaggtcgcatgcggaaagcagatcctcattaaagacataaacctcgtaaactctggcgggcgtgtcctccccagcgggcaggtcggtcacaagcgcgatcccggcgtccctgttgatcacaaggccataaccggactcctcacgcgtttcggtgcgcgcctgagcaaaggcttccgcggcatccgcggctgtctgaccgagcagctcggccgggtaagggattccgctttcaaagttgccctgatagatcgcattgccgcgcgcatgatagagaacaccctcgcccgaaagcaatccatcggcaaaagaaccttccagataaagctttccgtttctatagacgcttccggaaccttgggcaacgccctgttcaaagctgcattccagcacatcgcccgaggaaagcgatagccggcctgcgccctggtatatgccgtcgagcagttccccctcataaaggagctttccgcccggtccataaagttttccagagccggtgcgctgtcccatcacatacccgcctgtatagcaggccgcgccgtcctcaaaatattcgctcccctcgccgtcatactttcccagcaggaaaccgcccttgtagaaaagcgagccatccggccgaaacaacgcgccggaaccgctgtatacgccctgttcaaaatccccctggtatttgacggttccatccgggtaaaactcggtgccggcaccggagagcagtcctccggaaaaggttccggtaaactgcgctgcgccgtctgcaaagagcgtacccttgccctcatactgcccggagacaaacccgccttcatactgcttttgtccatccggattataaagcgtgccggttccgctgtagcttccctgatcgaagttgccctcataatgcacggttttcccgtcttcataaaagagcctgccagctccctgatagacgccctgctccaaattcccttcatacagcggcaggccgttttcatagacaaccccatacccctgacggacccccgccgcaaaatcgccctcataaaggcggtggttctgttcgtcataaagcgtccctttgccctcgtacaggccgctggcaaacatgccctcgtattgaagctggccgctctcatagtattccttgcccctgccggtctttgccccttcctccagctttccatgaaacaggagcaccgttttgccatcgtcagcatagagcttcacccgtccggtatatgtctccatacgcgtgtcggataccggcaggcaggcagtcagaaatcggctctgcacaaacggccagccaatataatatacgaacagcccgcccgcaatcaataccagggcgatcaccacaaacaggctcttggcgatgaatacaggcccggcgtcgatataatcggcgcgcgtctcgggcttgagcttcacctttgtcacgcttttggtgaccgccggtaccaccttggagaactgccggcctaaattggtcgcgcggcgcagccggaaccagacggcgcgaaacggacgtgtaaccgctgttcgaagcatgcgcagccccatccgcagggagcttgtaagttgtctgaatagcatcgtttctatttcctccgtgagcgtatccaatgggaagggccaaagccctccgaaagccctgtgcccggccctcagccctcgaaaatgcggtataccggatcgctgcacccctgggtgcagtaccggtcggcccagtacatatagttgcgggagacgccatcctccagcgaagcctgcaaaatctgcataaacagcgcccgcgccggttcataccgctgctggtagaaagcgtccaccgcccggcggtaaacctctgaataggactgcttgtgcttgagcagcgaatagggatcgccttcgtaaaggtcaaacagccgttccctgcggccgcccagatcggctaatccgacataacggctgcgatagccttcgatccgttcaaatacctgtcctgtacaaatgatgtagagactgctgtcccagcacagatccatcatgcggcgggcggtgtccatcgcatctgaaacagcggtgggcgacatgcgctgctcatctccaatgattccgagcagcacctcgcccgaaacgattgccgcacggatatccacgcggcaatcgtcagccgcgttcagggcggattgcgcctcgcgaatctggattgcgcagcgcacggcgtccgccggctcgccgctgaaaacggcatggaaaccatcatgcctgaagtcatatactgttccgccgttggcgctcacaagcggcgcgatccgctcaatcacccggttgatcgcggagaacaaggcgtcggccgtctgcggtgtcccgtccggaaatatgaaacgaaccagcagagtcgtcatatcggccttgacaaaggccgtcttgtctatctgctccagtgattgcgcgccgatcagccgaagcaggttttccggcacaaaccggagaaccgttttgttgacgcccgccaggcttgccacctgccgcctgataacgcctgtcatcgtgttgaaggcgcgcgacaggtcctccacctcgtcgccggaaaagatctcagtatgtacagcgtagttgcccgcgcttaccgcgtcaaccccgcgcttgagcctgcgcagtccgcgcaccacaaaccactgcacgacaagcagcaccagcagcatcaccgcgccgccgacactcaaaacaagcgcaatatcgcgcaaaaacatatcgatcgtgcgctgcatgccgaccgcgctggaagacacgctcagaagccttccctccggcagccgggcaaacagatagaaccgctggccgagctgttcataggtatcgacatagaccacaccgccctccgcgagcgcggcgacctccgggacgcctgcggcaatcgccgcctgcttatcccttagaggaaggtactggagcaaaacgccctccatcccgtgggtacttgaaagctccacccgccagcttccgttcatctcgcgcagcaaatcatacctcagaggcacctcggcagaaccgttcccctcgtgcagaacgctgcctttttcaagttcatcccaaagcgtctgcccctgaccagcccggatgccggcctcggcggtctgcgcggctgcaagcagccgttcgcggtactgccaggtcagcatctgctccaggctctgtgaaaatacaagctgaatcagcaggccggtcatggcggccatactgagcacaatcgtaatcgtctgtttaaagacgatcgagacgcgcattttcaaaaagtccacgtaaacgtcccaaaggaaagttgccacaagcaatactccaagggcgattgccgcgacccagaaaatttgcaggttaaagccgcgctgcccggtactgcccgtgtaatccatataactgctgccgccggtataaaattcaccgcccataggcgtgcgcaccacgcccgcaatgcgcagagacggattgaccgataccaagtcgaattgccgcagccgcaggccgctctcctcatagacgacggtttctccccgcgcgcagggatatgcggtcatcttcaccgggtccgccagatagagatccccgctggccatatccagaaaaacggctgcgccgtctccctgccgccagaagcggccaggcagcaatccgtcatcgatcgtgatttcacgcgcgctgtccccggacaaaagcgccagccgccccggggccgccgcgatcgcggtgctgctgtccagggccaggaagccggtgtagccggtatccggatattcccccaccttgcgggccgtctcaaaagcgccttccgccgccgtatacagttcgatcacctgccggccgtccgcgcccctggtaaagactccaaacaggatttctccgtccgcctcgctcacagaggaaaaccgcacgccgcctgtgagcgcctgttcggcgctctgatcgcagaaaagctcaaagagccgccctgcatgtgtcccgtttgcataaaaggcgtctattgcgatagaggaaattcgctcggtcagagggtcgacagcggcgctggccaccaacagggagccggtttcagacgcataaagatccatgacaagccgctcctgctcgtcctcctcaaagagcgccttttccagaaaacgctgtccggtgtcgtccacaccgattagcagtagcctgccgccggtattttgcaggcagtagatattaccccttgggtcgaggcagaccgcgccaagcgactgcctgcggctgacagtttccggattaagcacctggatgatatatccgccgaagatgccccaggcagccgctgccgtcacaaggagaatcagcagataggacagtatttttttcgccacggctggccgcgcctccttttctcagtggttttcccccgggacaatggtcaatacctgtatcgcgcgcgcagtgcgcgcccccccttgcgccgccgcagccaggtaaccagaccgtaaaacagccgggcaggcgcgtttttggcattgtaagccttccattcctcccggcggtcgcacagcgcgcgccaagctgcataggcggctcctaccgtccggtaggtacctatgcgcagcgcatcgagaaactccagttcggcccgcatggagcaaaacctgcgccccagcaggcattcgcttaatttcccaagctcaagcacagccgcatccccgcgctgaaaccgttccggccgcgcccgcatctgcaccgatacacggcggctgtcaagctccaccagaatattttcctcgcacagaaggctgttttgaagttccaaaggcaattgggaaagggcgatcgcctgtaggaacatccgttcctccagctcgtgccgcagctcatgtgaaaggccgcgtttgacggccgcgcgcagcggagcgccgcgcgcggcgcgaaagaccgcggcgaagcggccgtagtcggtgaatagttccaccaggccggggcatccgcgctcgcgcgcttcaaaaaagagcggcagcaggcgcctaaccgtctccgggtctccatagcggttgacaagcacctcggcgcgttcccgcgcctcgatatccacggcggtaaacgcctcataaccgccgccggactccagacggtcgatcaccttgtattttcccctgttcgccagtgcctccatcgctgcttcatccctttagaacctgtattcacattcgccgagcgccgtccgggcggttttttgccctcgctttgcatcaaatttcttgccgtgcgacagcccgcctgcaaaaatatgccttcaccggatgcaagtcccctcgcccggccggcatcctccggatgtgaataaaggttcttattcttctacaatcacaaaggtgctcgccgccgcttccgggtcggcggcgctgcgcgcgacaatctcaaatgtgccgcacatatccggcgcctgataaagcccgttctgatcgacgctgccgccgtccagatcccgcagctcccaaatcacctgcttatcctccgtgccggtgacaagcgccttcaggcgcaggcgttcgcgcacatgcacgcgctggacctccgggagcacctggatcgccacacggtcgtggagcttgaggctatccacatcccggctgaccttggcggcgaaataccgcacgcgcagcactgtgccgggcaccgtatcctggagccagacgcccacttggaaggtccccttttcgggatacaggataacgcccgtctccacctgcgggacggcgcggttgccgttcctggcgcgaaagacctcgccgttgccgaagaaaaggcggggctggtcgtcctctgtgaattccaccgcaagctggatgctcacatttcctggacccaggttgtggggcacctcgtccgaataatatcgcgcgttcacgcgcataccgctgctcatcgggatctccaccacaccagaggaggtgtcgtaatcgtatgcctgcgccgttgggatcccaaactggaaatcgagcgagccggtcgagcggttataactgacaccgacctccggcttctgccagtatttgagtgaacgcacctggctggcgaccttctccagcccatatccgcccgccgcgccgccctcctgcggacgacgcagcctctgcccgaacggcagcggcgtaacgccgcttatgatgctcgacgagccggccggtacaagatcgagccgcgccagatagataggcaggtcgttctgctccaggcggcgcgcaagcgtgtcacgccgcgccagatactgctccgcctccgtgcggccggcggccagatagacgctgttatccagcactacctgcacctcgtcctgcaaatcgcccatcgaaagccgcagcaacgcctgaccggaggccaccggcacggtcatgcgcatgagcggcgaagcgcgcagcttcatcgcgcggcggtaaaggcttttttgctccagcgcgttttctgtgaattccagatggatctcgccgctcccttcctccggcacgcaggcgtccgacggaaaatcgagggtgaaatgcagcggcaggctgccggcctccttcatcacaatgcattcgacggcgaattcctccccggctgtcacacagaccggaaagccgagcgcgatgcgcaccccgttcgcactgtaggccagacaggtatgcgtcatgccggaagcgtcgaaaatcgctccgatatccggctcgcctgtttcgagcgaaagggcgtagccttcgacgaatttgttgtactggatattttcaccgctctgtgcgccgaccgcattcacctgttccgcagcctgttcgcggtaccgcaggcagacaaacgcctcccgcttgccgatgatttcttcaaagccgtcgagcatctgaagttttttgatcactggcgcgtccaccacgatctcgcggcccatgcaatcgagcgccagcccgctctcaagcatcagcgtcatgtcgtcgcttttgctgactgtcagtccgcagaccacgccaggcccggcgatcgccaggttgagcagacgccgcttgtcgttgagatatttctgttcaagctcaaaatcccgcaccgtcagcagcttcccataaaaataacggttgcgttcaatcggaaacagactcagatttgtcatggtcatcccctccaatcatggtatcataccggatggccgcgctctcatcgatcgaggccggcgcatatccgccgatcccggagttaatgccgaggtaggtgtgccaatccagataagtactcttacgaagcaggaccagcttcgcggttacattagcgggcagcgcccgttccaggcgttccagcaggcggtcggcctcgccgggacttcggaaagccgtctcctccatcagtaaaaagaactgattgggatcggatccgtaaagctggctgtaaagcgcacggtcgcgtccctttttaatcatgtcctccacctgccagtgctccagcaggatcggggcgcttttggtccacagctttaccagcgctcggatgccccggggcgtctgtgccaggcttcccgcgcggaccgtccggaaaatctcctcccgcagctggctgtcttcaaggccctgtacgtcggcgtccacccaggacgcaagaaagcgcagcatctctccctgcgcccgaccaacatcaaacaggctggctgtgtgataaattgcctcctccaaatcgagcgacagactgtcaaagatgcttaaaaaccgccagacaaaactttcacgtccgccaagacggtagcaagcgggcagatagtccgccatatgatccccctgatactgcacgcggacggcacgcaccatcagcggcgcggattcagcaaaaacaagctccagacgcacccacagataccggccccggcaggaaagcagcagatctgcgccctcataccggtcctcaaagagcgcgtcaagctcctgcgcacgcccctcccgcagcagccgctttatcggtacgccgccggggtcggatacgtttgaggagcaaactcctaccgagatcagcgtattttcaggcaactgcccttccagagtcaggcgggtccattcaaagtcgcgctcccggctgtcaaaagcggggctgtaccagacaccgcgcgacacaccgccgctggctgcgggtgtgaggcagccgccggcgatctccattttgtcacagaaacctgcgcgccagtgcgcttcgctgttcatcgtgataaaacttctgcgctgcattttgttccccccgttcatccggcccgcttagggactgtttgaaaaatcaaaattcccgtctttttctacaaacagcggcggatgctgtgtcaaaaagccttggaatccgaaaggattcctgcgatttttgccttgcattttcctgctgcctgcgaaaaatccggcaattcctctattttcaaacaagccctaacgttccgagacatatagttccaatttttccagataggcgacggcatgttttgggatcaacacatccccctgttcactgtggcggcactgcgagcctttataggtcagagccgcacgccgcacgccgatgacgctttccgccgcgcccagcacgcccaacaaatcgttgagcagcaccggcgcgcccggctcacattccctaaaataaagctccagacgttcctgcgcctggcgcgccgtctccgcttccccgctttttgagagcacctccgcacgcaccaggatgggcacatagaccggcgctgtgacaatgacacgtgtacagacagtacggtaccgttccatctgcgccgccacacagtccaaaaatcgctggtccggcagcggccgcggacggccgctgtagggcgcggccaccagtgtcagcgtgttcggctccaactgtgaaaaaagattttccggccggtaatgtggaattgcctttacaaggcccacacgccggcccggcgtgcggcgcgcaacttgctcataatcccgcgccgtggccgcgcgcgaatcacagcgccactgctcccgcagacgcgccgccgcatcctccggcgtctcggcgtcccggcccggacgcacataaaaggcggcgccgacctgaggctgttcatctccgccgcggcctggggccaacagggcctgcccgtgcggcaatgcgccccgcgcgccgtccgtcagcgcaaagcctgtcaaatagactgcttctttaccgccctccggcgcagccccatacaggttgtctccaaacagcagtccgtctccatccagggtgtagacccggtcaaacgggcctgcctgctccagcgtatcgacatatgtccaatcctcgtaacgcacactcccatccgcgaacgtgcgcgcgcacatcagcctgaggcagcctgtcgccgctgtttcctcgccgtcaagcaggtctattcggccgccaggcaggccggtatgcgcgcgccgcacggcaaaatcccgttcccggcagcacaggcggacattgggcgcgccgtcctgcgccgcatcctgcgcggaaaagctgcagcgcacgccagcgatcccgtcccgcacggccggctccattgcggcgcttaccagacgccagccgcgtccatcgcgtacaaacaaatcccgctcaccgctggcagcaagacgcgtatacagctcaaccgaagccgtctcgccgcaggacactgtgaaatcaccgctttcagcgcgcgtctgccgctgtaccagccggccgcagccagcggcaatgcccaggatagcggggtcctcctcgcagcctggatctgtgatgcgcagccgcagccaacaaaattttggcagccccatgccggcgtcggagactcccaacggctccttcagccgcagcgacagactgcctgagaaggaaagcgcgaaggtttcatcccgcagcacctgtaccgggacggcgcgcgcgccgtccatcgcttcgatcacaaagatgcgcggcggcggatcgtccggcccggccggacggttgcggggcgacggatggcggtcgtctatctccacccacagctcaagatctgtttttgccccggaaaaggagaagccgaggtaaagcgtctcctcacgcgtcagcgtataaaacaccttccactgattcaaaaggcccgtgatgtcgtcgggccgttcgtttcgccctgcataggcggcgcacagccgcacatgccctggattccaggactcctccaattcaaagacgacgccgcccgccgaataaaggcgctcgccgcacgcgaacggttcctgtatgcccttcccggcggcaagcagattggcgcgcgtctcccggaccggctcgggcacgatccccatcagctttaaaaacatccgcagatgatcggctgtgatctggtccagatggtactgctgcatctgcttataccaggcaaacagctcgatcagagtgatacccggatcgtgctcattaaaatcggtccattccgcacatagctgcggaatgcgcttttttgcctcggttacaatatcttcaaacctctggtcatccagaaccggcaggttcagcaagctctttcacctcgtctttccatattacatccgaaccctgtgggttcccccctgtaccaccgtaaacggcaccgacaccgacccgtccaggctgacaagccggcggcggccatcctcataatagtcgccctccaaaaagacgtcgcgcaccgccgccacatgctcgacatacttgagcctgctgtaaaaatcggcggcggccggcagttccccgattccgcggatcaggccgcgcccatccgacggttcaagcagccgcctgatcgcggcgaccgcatcgcgctcaacctgcgcggcatagtcgaggtcgtccggcatcagatgaacggtgacgtttactgtcataaccaccgccgggatcaccgcaagacgttccagcgccatgcagtcgcagcaattctccagcatcgcacggatccgtctgcacaggcgcagcacataatcgcggttattaaaatcgcgtgccatcaccacaaccgtgacagctcccggagcaggccggccgtccgcaccggtattggaaaagcatttaacctgcaccacctctccgaactgttcgccgatcaggtcctcgtaatcgcgggcgcagaccgcccggtagcggtgacggacgcggcgcggacccaggcgttcaaccgcttccatcgtctgcaaatcgctgccgccgcaggtgggcgttatatttgttacgccggttatgtaagcgattgaaccgaccatgccaccgatgcgccctgcgggcaggttcccgcggctgcctccgcctgatgaatattgcacaaggatgctctcctcaccggcggccggcactttgccgcgccggccgtttccaaaggtgagccgcccttcgatccggtcgatctgatagacgcggctttccggtccggtccctgaaaagctgtcggtttcctcccagcgcacccgcaggcggatcagcgcgccttcctcatcatactcgggacgtatgggcgctttgggatcgtccaggagacgatcgcgctcctgctgcggcagctcgggcagctcgtctacccaaacctcgcaggaaagcacgggcctgtgcggcagaacgatttcacgcccggtctcgtgaatatcggccgcaaagagctggtcaagctcccggtgcgactgcgtaatgcccgccacgtttgtcaaaacacgcgtcacacggggcagcgcccccctgcgcgcgcggcgctcccccaggatacgcagaaaatacccttcgtgtccaaacagacggccgcgcgcgggcggctcccccagatagacgctcaggatgccgctgcccgaaaggccgtcggtccggtcggcggcatttaccttttgaaagccatccgccaaaagcgcctgcacctccagtctgtcaattccttcgcactgtccatccagatcgaagaacaggttgaccggatagccgcagaacggccggtcaaaacagaggtagacagccggcggcgtctgctccggactctcaaacgcgtccagagcaagattttccagccggtgcgcgtcggcaagtatctggctttcacagttgttgtccgaccgcacataatgggccggctgcgtctcgtcataggcatattgcagccggactccctgtacaaatggaagcagacggtcgccggtcgtgctgaaattgttttccacaaatcccacgcgggcgcgcagccaataattttccaccgcgcccacagtcaccggctccatatccgcggggcagacgcagctaagctccatccgtccctctctgcggcaggcgaacggattggcgtcgccctccacaaaaagccgtttccagcccgtgccgttccagtattcccatatcacctgtgaaatgtagatttccggcaccgatgtgagccggtcgtttttatcgatgatatattttttattgaattcataccgctggtccggcgtcatctgctgcaccacgacggtacgcatctccagctcaatcttcagccgcgccccgcgtttggaaaacgcctcgccgctggccagataaaaacagtcgtaaggcacgggttcccgcccaaagcaatagccgccaagcgcgcggtcgatcggaaggtcgttataaaaaagttcctccgcttcgagcgcagcgtcccttagcgggcttgtacgcagccgcgccgcgcgcaggcgaatctccggctgcgctccctgcatcacgcagcggatgcaggccggggcgtcagccccttgcgcttccatcgggccgtcggcggtcttttgcagcagtatggttttctgccgcgcctctgcatggtcaaaggcgctccagcgcgcgccgtcataatactcccatttggcggattccggctgtgcaagctgttccgcagcctgtccgctcagaagctccacatctgtatgcagctccacctccaccatgcacggcgtgtgcagcaaaaacagatccggatgccccagatagaggatatggctttgcaaattgcgttcgggatgcgccccgaacagctcggccgcatcgccggaaagggcgtcgtaccattcgatacaatccgcctgcggatgtaccagaagcaggccttccagcacggcggccgacgcgtcgaatccgctgtcggtttcatagaggacatcctccccgccgccgctctgtgcataaagctgcgtgcctttctccacgtgtgcgccgcgcgcgtcgggcgtctcacaggaaaagcgcgcatagcccacggctggcgtggcgggggtgcggcgggtatcgagcatattcagaaaataaaggaactgtttatatggaatccggttgtaccggcagatcgtctcataaagcataccgccaaagagttcggcaagcgccgctcctgcgtcaggctgctcaaaatccaggcgccattcgggcgtataccggcgcgcccgcgcggcaatctgggcgagcagatcctgtttggtccggctgtcgagcactggaaactgtttcacgcttcgaccccctcaagcaaatggaacgggtagaccaggttaaagtaattgttggtgctgcggaccgtatagctgatctccaccacggcggttgtatgatctttgccctccatacgggcggcaaccttcacgtcccggatgcgcggttcgcagcgggtaagcgcaccctccagctcgctggaaaccgacagcgcaaagtcctgggcgtccgattcaaaaacataatccgccgcgcgggagccaaacgacggccgcatgacccgctcgccccgataggtgcgcaggatcaggccgactgattgcctgatgtcctcctcatgggaaaccatcgcaatccgccctgtccgcgggtctaccgcaatgggaaagctccatccgcgccccagaaaatccctgctgtccatacgccttgcccccattcttcccgatcattgggatatcagttaatcttgaccatcgagcctttgagattcgccagcccgctcgcctgaagcgtcagctggccgcttgccttgatttcacactgtccggacgcttccatgccgatctgggcgcctttcagttccagctttgtcttaccctcggctgaaaccttcccgcctgttccgtcgagcacaacagcggcattcgatccggccttaagcgtaattttcttctcagcccggatggtgatctcgccgtttttcaatgcgactgttatcccgtttttgccgtccttgtccgcaaaggtaagcgtctcgcccccatcgtcaagcacaaggcggctgccctttttggtagtgatgctgattttctccttgtccttggcgtcgtccaaaagaagctccgctcccgatggcgtcctgatgctgcggatttcgttcttgccatcctgatagtggtaaggaccggcggcttccttcgtccaaacgctgcccaacacaaccgggctgtggaggtcgccgcccagaaagccaagcaccaccacatctcccacatcggggaaaaaggtcgctccatagcccttgccgcccataaagctcatgacccaggcccagttggtttccttgacctcgggattttttgtaagcaactgacagcgcacccggtcaagcttgtccgggtcctggatatttgtgacctttgccagcgccaccccggggacggctgagagctgtgtcatttcgctgcggttcgcgtcaagctggtccagaatgctcaattggtgcgcgcccccttcaattcaaagtcggtggtaaagccctgttccgaataacggtgcaccacccgcgagataaaatacaacccgtttgtatgcttgtccataccgtctattttcaaatagcggccgggcaccagctccggcaggccgatacaggagccgcggccgctgacaaattccatcgaccgttcgttaaaaatggcctgcgctaccctttttaaacccgcggcggtgaactccagcgggtcctgataatcgagctggcgcgtcttgagggccggcatcatcgcaagcgccgtcttggagcctgtgccggaaatatcggtcgcggtgatctgcgccagctccggggcaagccccacgcccacagagctgaccgtcaccttgccgatctgacggctgctgtcaagctctttttcaaagctcttgaggtgcctgccatattccagcgtcatcagggcgccggtttttttataaagctctgtaaaaatcacctgcccatggataatcgcaaagcaatatcccgcgcggcgcgccagatgtgtgatgaattcactgtcatccatgcccgattgaatcaaccggatcttattttggccgatcttgctgaccttgcccatctttgcatagccgttgaccgtgcactgctccaacagcttctgaatcaccgcgtcctgatcctcctgctcatatgccaccgattttttgatgttgcgcaacaggacagaggcgtccatggcctccaccgtgatgctgatcccttccggactgtaggtgtgacgcacatggacaatcagccccacaaagagcgtgatccgcgtgttatatccgccgttgacctcgacctttttcccaacctccagcttggcgagcaaatcccctgtgaacgcgcttttgtccagatcgaactggccggaaagctgaaaggtacaggagcttgcttcgccgcgccgggcgccatccccggcgccgaccggaatattgatctcaatcgattgcagctggcacgtctggtcggcgagcttcacgcctcccaccaggatttcaaacgacggagcggcgaagcccttatatttttgttcaagctggtcatagtcatagctgctgcttgtgctgaatgtgatggccgccatccgccgccctcctctgtccggccgggacgtttaaagccacgccggtattttgattacctgtccggttttcagcagtcttggattatcgatccggttgacccgggcaatctcgcgccacaattccggatcgccgtactcctgcgccgcgatggcggtgagggtatcccccgcctgtacggtccaatattttgtgcggtccggcgagttgcgcggttcccctgtgagctggtcctgcggggaaatatgccgctggaatgtgacctccagtctggcgcgcacaggtttgccggtaaaggtgaacatcaaaaattcctgccgcaccgaaacgacatacccctgaaacgaaagtccgccccatcggaattctaccagcggcggcgcatgccggtcgcccgccacatccatcagcgcataaatccggcttgtgtactccgttacatcgatcttcccgacctcgggcagcaggctggttgccgccagcttcactgaatcggcgatacttccggcgctgacgcccgcctcatatgtatcgaaaaacaggttcatggtgagccgttcggcactgccgttgacaaactgcgcaatgggcaggtcaagcccctggatcacatgctccgcgtagttcaccgtgcgttcaatcacatattcagacggattgaacaggacggtaataggggattgtagaagggttggcggcggatcgatctgataaattttcgccttttgcagcaataacggcatatcttgttttcacctgcgcttttctgtgtattacagcccgaaccgcctgcgttcggcgctgatcctgctttccagtttgcgatagatctgatccgccatccggcttaattccgcatcgctcacctgcccggactgccggatcacctgtgtttcccgtgtagtccgcacaggtgtgttgagcgagcgcggccgtcccgccgcttgaaaaggcaagcgccctgcggcgtccgtcccacgctccttgtaagcgatatccggcatcatcaggcgcggcggcacgccggccggcgcaatgccgcccgcctcacgttcgcgccgggccagctcggccctcgcgcggaaaaaggactgtgctttccgcgcctgttcgccggatagctgcgcgggaagcgggccgtccggctgcgcttcagccgcgtcccggcctcctgcggtaaacgccccgtgcggagcgtccgaccatccgacctttttccagtcctgccgtccgaccggcctggcggaaccttcaccgaaccgccctaaatatgaaggcgggttgagcatcacaatttcagaagggttaaacacttggcgcatcggtccctggcggcccgaaagcgccatttcaagcgacaacggcgtctgctccgcccgctgctgctccagtgtcaaaagagcgatccgcccccgccgttcaatcgcgccggccagatcaggggcctgcccggcaaggcgcgcggacatccgcgcgagccctccccgcgcctgcatgagcagaccgcggttttgccgcaggctgcggctggcgtgcagctcatcccagccgcggtctgaggactgcgcacggctcccgtctatggcagcctgcggccgtccgtcccggcgctcactcgcataggttcttatcacacggccggccggctggccgccaaacggcggccaatgctccccgcccagccgcgggccgccgccatccgccgcttccggcgcataaagcacaagctccgctgcggaaaatatgcggccatcctcccggctcggcccggaaagaagctccataagcgtggcgggcgtctgcggcgcacgtccggcaagcagcgcgatacgtcgtgtgcccgccgtagattccacagtcgtttcctgtccgggcagcgcgccttccacaagctttgtcagacgttctgaaagccggatgcgtaccggcgcacggcgcgcgtccggcaaagccctagcgccgggccgtttatgcacgcgccgcgctccccagccgcgcttcccagccgccgggctccttcgcgcctgcggctctgaaccttccggcacatttgtcaggcgctccaggcgttttgaaagcaagcgataaaacaacgccgccggccgcggcccgaacgtatttccttccggcaaaaacgtggttgactgcacctgtgatttctcggcgagcaaaacgagcagcccgtcgtctctgacgttcgcccatggtgtaaacggcttaccatgcctttcttccaacccgacggtacggctttctgccgccgcccaggaatacgcttcgtctgaataccggactgaaagccagcggctttcagtccgctcaaacgcatttctgccggcaccgtctgtatatgtcccatatcgaagttgaacaggcgggaccgcaaggtccgcctccctcacggacaacgccggaacggtttgtcccgatgcgctttctctatgcgccggacgccatgtccagggcatccattgcgtatgcggcgcaggccggccccccctatccgttccgcggccaaagaagccgccgtgtgttgggcgtgccgtgccgggtgttcttcccagtctgttcaaaagctgcgttagatccatgctcaacacctgtgtgaacccagcagtggaacccgcgctgcgcggcccctccacagcggatggaagatccatcccaaccggggcgggggcctcctcgcggtcgatcagctgctccggatcccgccggtgacgccatccgcccgacaggccgctgctgcctctttttcgaccggacagggcgcgctccgctccggagcgaagcatgacactgtgaatgcgcctattgaaagggctgtccggccgggctgtcaacacggccggggtccgcatttttccttggatatccgtctgcggaccgccgtccaaagacggaattctccacatttgttcaaaatctgggatacccgctgccgaagcggctgtgttctgcgcctgttcaaagggctgcgttcctgtcatattgctcaataggactggcgccgccgctttcgcactgtatacggtcccgggaagccggctttgcatccccgcgctttctcctgcccctctggagcgcggcgcggcggcagacagacggtgggggttcgcgttttgcgcaaacgccgctccccatccggcttgcactgcgaaaacagacgaatagcgaacataagcatccttcgcctgtgcggtttgccttgtccatcccatctgtgtgggaatgggatgcggggggttcacttagataaagataccacaccattcccacgctgacttttgctcaaccgatacagccggagggctggatgaacacagaagttaagctcagttgtgccgacaatacttggcgggtgactgcctggaaagataggtctttgccagcacttgccgcagtatgataaccatactgcggcatccatcttctttatattcctcaatagctcagccggtagagcatgcggctgttaaccgcagggtcgttggttcgagtccaacttggggagccaatcgttggtgtttattacgctgaggttccacctgttcccatcccgaacacagaagttaagctcagttgtgccgacaatacttggcgggtgactgcctgggaagataggtcttcgccagcacaaaaaaccttcactttttagtgaaggttttttattttctttattcaattcgggttgccatgaatgttgtaagatgccttttaactaaaaaataaatgggaaaaattgtttaaaagcatttataattccgtcgtgatcaacatcagtcgttatataatcagccgctcttttaaccgcgtcgctggcattgcccatggccacgccgataccggcggcacgcagcatatcgatgtcattttctccatcgccgatcgccataacatctgacattggaatggaaaaatgcgctgcaagcttttcgattccaaccgctttggagccgccgcttggtccaatgtctgaaaaataaggactccagcgcgtcgcggcgctgtgcggcatagcgtccagatagaaggcttcctgctcttgcggcaggaaaagattaatttgataaatattgttgtgcagcgcctgtttcacatcgcccaacggcggtgtagagaatttaacagccgaccaggcccgctgaacgtgttcatcgattaaattggcatacatccggtcgcgctcgatcaagaggcaggcgctcggcttttcatcaaggcgtgcaagcagacctgcaacatccgcaggctcgatgcgcgcttcatggataacctcgccggccgttgtatagcagaattggccgttgagtgttacgtaaccgtcaaagggaaagccctcaaggatattgccctcctctataagcaggcggtggcggcctgtcgcgataaagagacgcacgccatgttcccgcaccgcgcacaaagcgcgtttggtgctttcggggatggcatgcgtctgaaagctgacaagtgtgccgtcaatgtcaaaaaaaattgctttaatcaaattatatacagtcctttcaaatgatggttgtgggctatggctgtctgatctggattttttcaaaactcacggatcagtgccaccacttggccgagaatcgtcacatggtctgtataaattggctccatagcgtcgttttccggttggaggcggtaccgttttttctcacgaaagaaccgtttaactgtggcctcgtcgtcgatcagcgcgactacgatatcaccgtcttcagccgtatcgcgacgttgtgcaatgacgatatcgccgtcaaggatagccgctttgatcatactggaaccccgcacacgcagcgcgaagaaatccttggcgtcgccgcgtattggtacaggcagatatgcttcaattgattcaaccgcaaggattggttgaccggctgtcactgtacctacgagcgggacgcgcgtcacattgccgcatggcaggcgaatcgcccggttgaggctgccttcacgttcaatatatcctttttcctcaaggctctttaaataatggtgtgcggtcgacgtggatttcataccaaggcgcgcacatatttcccgtacgcttggggcgagtccatgatcgattgcgtcacggacgacctcgagcactgcggcttctttggcgttcagctccggcatggcccatccttctttccggcctttttgagaaaaggcctcaatataaaactttcctgcctttttgaaaaaaggcctcggcggaaactttaatcggctgcgctccagcctttttgaaaaaaggcttcggcgaaaaactttaatcggctgcgccgcgaacagtgggtttggcactgcgttgatgcaggctgcgccgcaaacagtggggcgggcgctgcgttaatacaggctgctacgcgaacagaggggcaggtttcagcatttatgcaggctgcacctgcctctgggttgggttcatgggccagaggcggcctggcggtttaccacagaacgcaccggcgcgcccgatacgatcgcgccaaacagaggcggggataacataaggggaggagcgccgccgcttttgaaaatattacgtgaatattataacaaagtgcaaaataaaatgcaaatttcttcctatcatcgctgccgccgctggtaaagcggcgtataattttgaaacatatgttaccagtatttatagtttgttaagagaagatgtcacttttttttataattcagacataagtccgtaacaaacaaacttgaaattggggtataataaaaacgtactcaagattagccgcaaatatcttgagtaactctaccctcctcaaaacacacctcaaacagattcggaccggatgtcaggacatccggtccctctttttgtccacagggaatgcgggccgtctaaaggcggcccgctgcatgctgttgtcaaacgattgtacaaccgccgtcggcaagcgcgcaaatggtacggtcaaaatcagtcgcatgtgtgagaatgtaatccgtgttataggttgatacagcaaaaacaggaatttgcgcggcagccaggagcgcggtgagcgtggaaagcacgccggtcagtgaaaaatcaagcgtccccgcgatgcgcagggcgcgccatccatgctcgcagcagcaagcattcgcaggcgcccggccggccgaacagacgagggagtattcggtatccgtcctggcaagaaagagaaatgggtccgaccaatcgaccaaagaaaaatccggcagcttacagacagaaaagcagccgtccagccgttcaatcaccattataaaattcagctccttttttgcagggccttcatttgttgtcctctgactgtgtatccaggttataaaaagcagaccgtaccaaaggacgcgctgcgtccatcctgttttgcacactcatagtgtctgcatttggaaatgctcagacatggcgccggataagaaagggccgttaaaatgcaacctgatagccaaacaagggcagcacgatggcaaacaggccgatcaaaaggggctgatgcgccagataaatcaacagggaatgacgcccgatccatgaaagcgcggcgcaatgccctcggtaaaacatcgccggcaggcgctttttctttgccaaaacgccgaaagacgcgcctgcgaaaaatataaacgcccaagggaaaagcgggaagtaatcagcggacacaaatcccggcgcgggcagaccgagccagaacaggtacggatttgaatacagcgtatccggcagccgtgcggacagaggacccataccaacgacatgccagggaagattgtacgttgccaaaaaacagactgcgaacaggcaaattccagccgcaggccggatccggtcaagcagcggccgcagcggaataaacagcagcatacacacgcccagcagatgcaggatgccaaacagatcgggcgtggcgggcatgacaaaaaaggtgacgactgtcacagcaaaggcacaggcgagcgccgccagtccgcgccgcagattgctgcgcgaataacggctgaccgcaccggaaataaagatgaacgtaccggcgacagccggctgtaaaaaccgctgcataaccgatgaaaaaaaccaggtcagatcgacgccgcttgtaacgagatcgagcatgccgtggtaaaagaccatcaggatcaggcacaggccgcgcacctcgtcaaagaggacgacacggccggccggattcgttttggacatggctttgctcctttcggcgcgctgttgtcaggtgcgcggtatatactgatcgataatcgagcgcgcgccctcggtatcagccagcgtcagcatgataatgtatccgccctgctcaaatatttgggcgtcctgcgcgatctgataggaatcgtagacatcgtagttttcaaactccttaatccttgaaagcttgacgctttccagcatctcgcgcaccttgggcgcgtcgtccgggcttgacggcttgagaataaacacatcagccacgccgaaccggcccgaggaatagcgcacataaaattcatccaaaagcgacgtgtcgataaagaatttgtccgtcaaatcctcctcggaggcatcggaaagaccgtcgatcgtgaccgtttcataaattttttcaatggcggcctccgggtcaggttcgctgacaacaggccctgtctgcataacggccatgccgctgtcggcgacaggctgattaccgccgcaggcggccaggctcaggctggcgagcagcgcgcagcaaagcgcaagacgccgtatatattgaatcataaatatcccccattccgccgcacggcgcggcataaataaaaatgaaagcgcctgcggctgctgtggcaggcagccgcagagggccgtgccttcggccttcctttgcaggcgcgtttaaactggctgttaatagtataccgcatcggcgcgattcgtcaagcgccgccttttaagagccgtgcggttgccaaatcggggcaatctatgatacaatagcttcatcatatcggccgcgtcagcggacggatagaatcgtccgcgggtgggttttgcgcgcgatacgcgatacagggggagacatattatgcaaacaggacaaataatttttctggcgctttgcgctgcggtgttcattatcggcatcgtgctttttatttataaaaagatgcatcccgatacgatagaaaatgaaaagcgcaaagtatccaaacggctgcgcacatttgccgcgccgcgcggctttcgcgtgctggataatgtgcggcttgtttcaggcgggctgtccggttgggccgatcatgtgctggtaggctatttcggcgtgctgcttgtatatgatctgtgctatagcggcgaatattacggcggcgccgacgacaagcagtggattatcaacgacaaaggcaaacggtatgccgtcgataatccgcgaatccatgcgcagcagtgttccggccgtgtcatcactttgctgcgtgaggcgggatacagggtgaatgtcgacagcgtcgccgtcatgacggtcggcggcaaaaagacggaaagttttctcaagacagacggcgccatcaagctttcgaaactcggcgcatatcttggacgcgggaaattcgacgaggacaagggccttgacgtggcaaaggctgtggctgctttggaagctgcaagccgatagcgggacggccaaggggtgatggaatcgatggaaaaacgtaccatactggagctgcgcggattatgccgccggatcaacagtgaattttatctgcatgacattgatctgacgctgcgcgagggggaggtaggcgccatcgtggggcgcaacgcctcgggtaagagcacgctgttttcggtgattatgggcgtatttgaggcggacagcggggagatttacatagacgggcgccgcgcagtgatccgcaatacgacggaggccacagacaatggtttgatcctgacggcgcagaatcagcagatatttacgaatctgtcggtctatgaaaatatcttttttgggcaggagctgcgcgcgccgggcctgccggtgatcagcaacaggcgtatgatcgccgccacgcaggaattgttccgagatatggggttgtcgctcgatccgcgcgcgccggcgtctgcgcttagtccggcgcagcgccagttgatccaaatcgcgcgtgcgtgcgtctctgagaatgcaaaggtctttttgttggatgagccgtcgacacgcctgaacgctgaggaaaaacaatgtttgtatcgtgcggtcaatgggctgaaagcgcgcggcaaatcgtttttgattatctctcacgacttggacgaggtgctcgccacagcggatacggtatgtgtgatggaggacggcgcgcttgtgcgtgcggctccgaccagttcgtttgataaggccgcattgattgaagcggtttatggcgtcaaagccaaagatctgtataagcgggaaccggttgaattgggggatgaggcgctgcgcgccgagcatctgtgcgggccgggctttgaggacgtctcgctgacgctgcggcgcgggcagatcaccgcgctgatgggcgctgcgggctgcggtaaggaggagcttgcgcgcgctttggcggggctgtatgaatataccggagcattgtatgtcggcggcaaggcgctggagacgcgttcgccggtcgcggcaatgaacgcgggcgtcgtgcttgcgctcgacgcacaggacgaagctctgatccgttcctacgatcaggcttcgcagggcggccggcgcgacggattgggtgtacgtgcaagcgtcggttgggatacgtttaccaaacggctgggccgcaccttcggcgcttatatcggtatgcgcgaacgcggagaatatatcactggcggcaatcagcgccgggaactggccgaacgcgccatacgccgccgcggtatcgtttatattctttgtgacgcgactgccggcgtcgatatcccggcgcggatgcgcctttattttgaggtgaacaagctgctgcaaagcggcgcggccgtgttatggctgacttcggacgccgacgaggctgcgggcctgtgcgacgagacaattgtgatggataagggacagatcaggcgcgtataatccatgcgctaaggagcggcccgcgcgggccgctcaccgccggacgctgtgtttgcctggcggcgctggctatgcggggctttccggcgcaatagcgccggccgcgatttattcgcgcctcacaaggaggagggtcgaacgaccctcctccttgtgttatccccacctctgtttggtgtaagcgtatccgacgctcgccggtgcgttctgtggtaaaatcgtcaagctgcgcctgccctggggttgggtccatgggataggggcgccctgcccctgtcccatgaggcgcgccgcgtggcgctgccgcagcttgtctgcgcccgaagtgcggcgactgccgcgcttcggaaagccatgcgaaggcggcggacgccggagtggacgccgccgctgtgacccgcgcacgggtcacgcgcgccatgcacgccggaacgtctggaggggaatcgttacgtcgcgcccagcgggattgacgaatccgcaaaatagaaatataatgacggtaatgatttttttcgggtatggtccacataaaatggatgttgggccaaattgaacacagggaggtaattactttgggaagggtttacaatttctcggcgggaccctcgatgttgccggaggcggtgctcaaacgcgcagcggctgaaatgctcgactatcaagggacgggcgaatcggtcatggagatgagccatcgttccaaggagtaccaggcgatcatcgaccattgcgaggcgctgctgcgcgaagtcatgaagattccggacaattacaaggtgctgtttttgcagggcggcgcgtcgagtcagtttgcgatgatcccgctcaacctgttaaacggttctgggaaggccgattttgtcctgaccgggcagtgggcgacaaaggcgtatcaggaggcgtcgcgctatggctcctgtaaggcggtcgcctcctcgaaggaccggaccttctcctatatcccaaagctggatcctgcttcctttacgccggacgccgattattttcatatctgcctgaataacacgatctatgggaccgtctggcatgaactgcccaatacaggaaacgtgccgctggtcgcagatatttcgtcgtgcgtgctgtcacagccgattgatgtcgggcggttcggcttgctctatgcgggcgcgcagaaaaacatgggacccgccggcctgacggttgtaatcatacgcgaggacctgatcggccgtgcgcgcgaatcgacgccgaccatgtttaattatgcgacgcatgccgagaatggttccatgtataacacgccgccgacatatgcgatttatatctgcggcttggtacttgaatggatcagggatgaaatcggcggcctggaagccatgcaggcggtcaatgagaaaaaggcgaagctcctttatgagttccttgacagctcaaagctgtttaaaggtacggtcgtccccgaggaccgctcgctgatgaacatcccatttgtgacaggcagcgacgagcttgacgcccaatttgtcgccgaagcaaaaaaagccggatttatcaacctcaaaggccatcgttccgtgggtggtatgcgcgcctccatttacaatgcgatgccggttgaaggcgtcgaaaaactggttgcgctgatggcgcgctttgaaaaggagaacgcctgatatgtatcatattaaaacgctcaataagatcagcccctatggaatggatgtgtttgaccgcagcaaatatatctgcggcgaccatgtcgaggcgcccaacggcattttggtccggtcggccgccatgcacgatatggagcttggtcccgagcttgccgccattgcgcgcgcaggcgcgggcgtcaacaacatccctgtggaccgatgcagcgaacaggggatcgttgtatttaacacgcccggcgccaacgccaatgcggttaaggagcttgtaatctgtgcgcttttgatgtccgcgcgcagggtattccccgcgatggaatgggtacagacacttaaagggcagggggacgaggtgcccaaactggttgaaaaggggaaatcgcagtttgtcggtccggagctggccggaaaatcgcttggcgtgatcggcctgggtgcgatcggcgcgcgtatagcaaattttgcccgccatctcgacatggaggtctggggatacgatccatatatgtcggttgagacggcctggaatgtttcgcgcagcatccggcgtgcatccagccttaaggagatctatgaaaactgtgattttatcacgctgcatatcccctccacgccggaaacaaagggcatgatcaattcacagtctatccagatgatgcgccacggcgtgcgcctgctcaactttgcgcgcggtgatttgattgtcaacgaggatttgctcgccggactggaggaaaaacagatccgctgctatttcacagatttcccaagcgacgaactgctcggccatccgggcgttatggcgattccgcatctgggcgcgtctacaccggaaagcgaggataactgcgcccgtatggcggcggaggagctggttgactatctggagaacggcaatatcaaaaattcggtcaatatgccgtccgtttcaatgccgcgcagcggtgatttccgcgttgcgctgatccatcgcaatattcccgcgatgctgactaaaatttccgtgctgatttccgatgctggtatgaatatcgagaacctcaccaataaatcgcgtcagaactacgcatacacgatgatcgatctcaagggcgctcccaccgacgagctggccgccaagctgcgcgcagtcgaggatgtaatccgtgtgaccatctatcgttaaaacaacatgtatgaaagccccccgcgtaaagcatgtcgcttcacgcgggggttttttgaaagaaagagcgcatggcatgcgggggagcgctgcggcaggagcggccagccagacatatgacgcaatcggccgcgtgcgcgcccggttggatgagattgggcgcattgacgcgctccgaaaagtccgcgcgggcggaaatttcgcaataggaattcattcgcatattgtgaaataagcttgaaatgtggtacaatatatgcagggcaaacagcgaagctgtatgcgggccgcgcccgcgtatcgcccggcccaaatgctgctgcaataaccgctttgcgcttattgcagcgtacacacaacggatcccgcgggaaccggccatcaatcaggaagggaggattgccggcatggaactgaactatgtaccgatcatctggctcgcgcttgggattgccttcgcggtcgcggagggcctgacggttcagcttgtttccatttggttcgcgatcggcgcggccgtaacggcccttgtaacagccttgatcgacatcccctggccgacgcagcttttaattttcgtaattgtggccggcgtgctgctggtagcgacacgtccgctcgccaaaaagctgctgtttgtcaaaaagcagagcaccaacgctgacagcgttatcggacaggtgggcgtggtgctccaggcgatcgacaatgacctggccacaggccgcgtcaaggtgaacggtctggattggagcgcacgctcatcaaacgcagacgccatcgcggaaaatacaagggtgcgtgtgcttgcgatcgacggcgtgaagctgatcgttgaacgctgtgaataaccagatattggggaggattatattatggcaattgttttgggaatcctgttgttgatcatcctgatcgttgtgatcagcaacattaaaattgttccgcaggcttctgtctatgtcgtcgagcggctggggacgtatgccgggacgtgggaaaccggattccatatcaagacgccgtttatcgaccgcatcgccaaaaaggtttctctcaaggaacaggtggtcgatttcgcgccgcagcctgtgattacgaaggataacgtcaccatgcagatcgatacggtcgtgttctatcaggtgacggacgccaaattgtttacctacggcgtggagcgcccgatgtcagcaattgaaaacctgaccgcgacgacgctgcgcaacatcatcggcgagatggagcttgacagcacgctgacctcgcgcgacaccatcaacacaaagatcaccgccacgctcgacgaagcgacagataaatggggcatcaaggtcaatcgcgtcgaattaaagaatattctgccgccgcgtgaaatccaggacgcgatggaaaagcagatgaaggcggaacgcgaacgccgggaagcgattctgcgggccgagggtgaaaagcacagccagattctggtggccgagggtgaaaaagaatctgctattttgcgcgccgaggctgaaaaggaatcggcgatcctgcgcgcggaaggcgtccgcgagcagaaaatccgggaagcgcagggcgaggcggaagcgatcaggatggttcagacggcgtttgcagagtcgctgcggctgttaaacgatgcgaatccgagcgacagcgtcatcaggatcaagggcctggaggcgttctccaaggctgctgatgggaaagccaccaagattatcattccaagcgagattcagtcgcttgcggggctggccacatcatttaaggagtttgtgaccgacaaataagccgcgccgcatagcaaaagcagggcgggttttaaacccgccctgcttgcttgtttgaatggctttgcattatgcgcggtcatgcgcggcgccaaacgagtcaaatgcgtccgaatcccatgcgcccgcaagaaggcgcgcgagcagggacaaatcgctttcctcctcgaaaaaatcccacccgttttcctgcgcggctgcacgcgcggcaaggctttcatccggcaggccgagcgaagtgtccgccaaatagcaaaggcacatgcagtcgccgcgcgcgctgtcgaacagcggctcggtacaaagcggaaggcgccagcagacgccgccgtcaaaccggcggaacaggcggcggtagcgggcgggtccgagcagcagggaagcggcgctatgtacacggggcaaaataatcgggcgcgcgcaggaggcgatgggcgcgccgtcctccggcagccagacctcgccgtctgcgagcagcagcgcgtcataatccgccgcgtcggcaatcagaccgcccagggtctgattgtcaggcgccgcaggcagataaaccggatcgatccggtgcggggaggcggggagcatccgttcgagatagggccgcagaggcgcgctggccgcgagaagaagcttcatcggttgttcacatccaattcatgaatttctattatgagtgtatcccatctgcgcgagaagtgcaatgcaaagaatttggtaaaagcccgcccgggcaaaggagaggctatgttcgataatcaaaagcaaacgattcagcgcgccgtgctggccgccgtcgatacaggcgaatatgacatacaggcgtcgctggacgagctggaggccctcgcacagacagccggcgcgcaaactgccgcgaagctggttcaaaagcgtccctcctgcgatccggcaaccgtgattggcagcgggcggctggaggagttggcgcagttgtgtgaaaacgacggggcggatctggtgatctttgactgcgagctgtccccagcccagcttcgcaacattgaaaatgcgtgtggcgtggctgtcatcgaccgcacggccctgatcctcgatatttttgcgcagcgcgccgtgacggccgagggaaagcttcaggtcgagctggcgcagctaagataccggctgccgcggcttggcggcatggggaaggcgctttcgcgcctgggcggcggcatcggcacgcgcgggccgggcgagacacagcttgaaacggaccggcggcatatcaggcggcggattgcggctttgcaggagcagctcgcggagctgaaaaagcgccgcggcctgctgcgggcgcggcgcaaaaaggagggcgtgacgacggtggcgatcgtcggttatacgaacgtcggcaagagcacgctgctcaacgcgctgaccggcgcgggtgtgttgtctgaggataagctgttcgccacgcttgacccgacctcgcgcgcgctcacactgccggacggccgctccgtcatgctgatcgacacggtcggacttgtccgccgtctgccgcatcagcttgtggaggcgttccagtcgacgctggaggaggcggcgggcgctgaccttctgtggtgcgtatgcgacgcggccagcgatgaaatggccgaacaggtcgacgtgacgcgtcaattgatgcgggagcttggcgcgcaggatattccgatgcttgtaattcttaacaaatgcgacctggtcgccgatgtgccgcgtgcgcttaatcagcagacggcgctgatctcagcgcggaccggttttggctttgatatgctcttgcaaaagacctcagagctgctcgctccaacgcaccggcgcgtcacactgatgctgccgtatgacaaaacagggctgatcagcgagatcatggcgtccggcaaagtatacgcgcagacatatgagccggaagggacgcgcgtcgacgcgctggtcgacttgcgtttgcttcacaaggtttcccaatggcgcgtctgataaaaacagcgggtccgcgattgcggacccgctgttttaaacgcattgagtaaatctgccccgataaaacggcggccagccaaaggaaaacggcgctgtttcaggcggcagagggtttcatacggacgtttattccctgcctgcgctttcccggatatgcagagcgcattgaaaacgctccatacgcttcaggatagcgagaatctgcgtctgcgtcatattgattttccatatccggcctcccgttgtgcgctgccgcgattgcttatgtaaattctgctttctccagaaaggccggcgtgccgggcgtatgacttaaaaaaggtaggcgccgagaatctcggatacatacagaaaatgatagtccttttgcggataattggcggcgtcgagggacgtatcgataaaaccggccggatcgagctgctggcaaaacagcttgcggcaggttagcgccgtctgcgactgggcaagcacgggcgcgccgtcgagatgcagcgccgaaaacccgcaggctgcaagcttatccccgtcgcggccggagtgcgcgccgcagtaactaagctgcttgcggtaatcttcgggcagaaagcacacggaaaacagctcgctgccgtcgagcagctcgcgtgtgaaacgctgcgggcgcaggaaaacataggtgacgggcttgttccagaggattccgacgccgccccaactggcggtcatcgtgttgatcatatcgccgcgctgcgtcgtgatcatagcccattgcttgccaatggcctgaaaggcgttgagcggcagctcataaggggaaagcttctgcataatctcgcatcctttcgtcaattgggccggcgcgccggccggccgcgtgcgttattccggtatgttgactatattatagcacaccccggcaagaaaaagaactgacaagccgatgcatatggatgcatattttatcattgttatgaggctgaaaagtgaaaaaggcattgagttattcgtgtatttgtgcaataatacccaattcatcaattctcaacatgaatatttatgcgaaaattgggcttgaaattgcataaatataatgtataatagggtacagatcatataacgccgatattggaggaatcaccgtggagcagaaaacgtataaaaaagttgtgcttgcctattcgggcggcttggatacatccgtcatcatcccgtggctcaaggagcattacaagtgtgaggtgatcgccgtcgcggcggacgtcggccagggcagcgagcttgacggcctgcgtgaaaaggcgatcaagaccggcgcttccaagatttatatcgaggatctgaccgaggcgttcgtcgacgaattcatcgtccccacgctcaaggccggcgcggtctatgagggaaaatacctgctcggcacttcattcgcccggccgatcattgcaaagcgtcttgttgaaatcgctaaaaaggagggcgccgacgcgattgcgcacggctgtaccggaaagggcaacgatcaggttcgctttgaactgaccattaaggcgttcgctccgaatatggatatcatcgcgccgtggcgtttctgggagctgaacagccgcgaaaaggaaatcgcatacgccgagcaacacgacattccgctgaagatcagccgcgaaacgaactattccaaggacaaaaacctctggcatctgtcgcatgaggggcttgatctggaggaccccgccaacgagccggattacgacaagatcctggagatgggcgtttcgccggagaaggcccccgacacgccgacgtatgtcacgatcagctttgaaaagggcgtgccggtcgcggtggacggccagaagatgaccgcgacggagattgtcaaaaagctcaacgacttgggcggcaaaaacggcatcggtatcgtcgatatggttgaaaaccgccttgtcggaatgaaaagccgcggcgtgtacgagacgcccggcggcacaatcctttacgcggcgcaccagtcgctcgaggagatcacgctcgacaaggagacgcagcattataaaatgcagatggcaatcaagttcagtgagatcgtctacaacggccagtggtatacgccgctgcgcgaggcgatgagcgcgtttgtcgacaagacgcaggagacggtcacgggcgatgtgaagctcaagctctacaagggcaacatcatcaacgccggcatgacttcgccgcattcgctgtattcggaggagatcgccaccttcggcgaggaccatgtctatgaccaggccgattccgcgggctttatcaacctgttcggcctgccgatcaaggtcaaggcgctgctcgatgaaaagaagattaagtgaacgaaaaacggggctgcggcgcgggggcgggaccccgcgccgtagccgtttcattttcgccgtccgctgtccgcggagggctgactgtttggaggaaatcaaatgaagctgtgggcgggacgcttttccaaggaggcggacgagcgggtcaacgattttaattcgtcgatccggtttgattcgcgcatgtatgcgcacgatatcaagggttcgatggcgcacgcgcagatgcttggcgcgcaggggattatcccgcgcgccgacgccgacgcgatctgcgatggtcttgacagcatttgcggcgatctgcaaagcggcgcgctgctgttcgatccgcaggccgaggatatccatatgtttattgagcaggaattgacaaagcgcatcggcgacgcgggtaagcgcctgcatacggcgcgctcgcgcaacgatcaggttgcgctggacgtgcggctttatctgcgcgacgaagcggcggccgtgcgcgcgctgcttttaaagcttttggaaacgctgtgcgatctggccggcgagcacctggagacggtgatgcccggttatacgcacttgcagcgcgcgcagccagtcacgctggcgcaccatctgatggcgtatgcgtcgatgtttatgcgcgacgtggggcgcatcgccgacgcgtcggcgcgcatgaacgtctgcccgcttggttcgggcgcgctggccggcacgacctacccgatcgaccgcgcgatgacggccgcggcgctcggctttgccggtccgtcggaaaattcgctcgacggcgtgtccgaccgcgatttctgcatcgagcttgccgccgcgttctccacggtgatgatgcacctgtcgcgcttttcggaggagatcattgcgtggtgctcgtgggagtttaagttcatcgagcttgacgacgcgtttgcaaccggatcgtcgatcatgccgcagaagaaaaatcccgacgtggccgagctggtgcgcggaaaaacggcgcgcgtttacggcgacctggtgacgctcctcacaatgatgaagggcctgtcgctggcttacaacaaggatatgcaggaggacaaggaagcgatcttcgacgcggcagacaccgtgaagctgtgccttgtgacctttacgccgatgctgcgcacgatgacggttttaaaggacaatatgcgcgcggccgccgcgcgcggctttatcaacgcgaccgactgcgccgattatctgacgaaaaagggcgtgccgtttcgcgatgcgtacaagatcacgggcgggcttgtggcacagtgcatcgcgcgcgggctgacgctggagacgctgccgctcgacgattacaaggcggccagcgcggcgtttgattcggatatttatgaggccatcgcgctggaaacctgcgtgcgcggccgcacgagcgccggcggcccgtcgccgcaggcggtgaaagcgcagattgcgtctgcgcgggcatttttgcagcgtgaagctgcggacggcggtttggaggggtaaggatgaaaacaatcaaagcgggcgtgatcggcgcgaccggctacgccgggcttgagcttgtgcggctgctgctggcgcatccgcacgccgaggtgacggccgtctcctcggtcagctacgctgggcaggcgatcagcgccgtctatccgcagcttacggggctgtgcgatctgacgctgacggacgacggcggcgtgatcgacgcgtgcgacgttgtgtttacatccatgccggccggccacgcggagccggtagcccgccggtgttttgacgcgggaaagctgatgatcgaccttggggccgatttccgtttggaaaacgaagccgattaccgccagtggtacggcgggcagtacgccgacccggcgctgcatcagcaggctgtctactgcatcccggagctgcaccgcgcacgcgcgcgcggcgcgaagctgattgcgaaccccggctgctatgtgacgtcggcgtgcctggggctggcgccggccgtaagctccggcgcggtcgatctcaaaacgatcgtgatcgacgcaaaatccggcgcgacaggcgcgggacgctcgctgacgctgaacacgcattacgccgaatgcaacgaggcgttcgcgccgtataaggttgctgcgcaccgccatacgcccgagatcgagcaggtgctcggcggcgtagcgggcgtgcccctgacagtgacattcgtgccgcatctgctgccggcgaaccgcggcattgtctcgacgatttattcttcgctcgcgcccggctttgacctggcgcgcgtgcgcgcgctctatgaggatttttaccgtaacgaggcgtttgtgcgcgtgctgcccgacggcgcggtcgcgaacatcaaaaatatcaaatactccaatctctgtcacatctcgctgcacgccgacacgcgtaccggccgcctgattgtcgtatcagccatcgacaacatggtcaagggcgcggccggccaggcgatccagaacatgaatatcgcgtgtgggttgccggagggcgcgggtctcgtgctcgcaccgcccgcattttaatagaaggagaaccgtctatggcttttacatttgtggagggcggcgtctgcgccgcacaggggttttcggcgggcgcggtccacgcgggtatccggaaaaaccacgataaaaaggaccttgcgctgatctttgccgaccggatgtgcagcgcggcggccatttacacacagaacaaggtcaagggcgcgccgctcatcgtgacgcgcgagcatctgcaaaacggccgggcgcgcgcgattttgtgcaattccggcaatgcgaacacatgcaacgctgacggcctcgatattgccgccgcgatgtgcaaaagcgccgcacaggcgctgaaaatcgcggcgaacgacgtggtggtcgcttcgacgggcgtgatcggccagccgctgccgctcggcccgatcagggacgccatgccggcgctggcggcgtcgctttccgccggcggcagcggagacgccgctgaggcgatcatgacgacagacacgaagcgcaagcaggtcgccgtgcgctttccaatcggggagaagatgtgcacaatcggcggcattgcaaaaggctccggcatgatccatcccaatatggcgacgatgctctgctttgttacgacggacgcggacatcgcgccggagcttctgcaaaaggcgtgcaaggatgtggccgacgagacgtttaatatgatctcgatcgacggcgatacctcgacaaacgatatgcttgccatcctggccagcggcgcggccggcaacgagccgatcaaatccatcggcagggaatactatcacttccagcagggactgatgatcgtctgccggcgcctggcgcgcgagctggcggccgacggcgagggcgcgaccaagctgctcgaatgcgccgtgactggcgcgcccgactgtcagacagctaaaaaggttgcaaaatcagtgatctgctcgagcctgtttaaagcggcgatgttcggctgcgacgccaactggggccgcgtgctgtgcgccatcggctatgcggacgcggagtttgacgtggaccgcgtgggcgtgacgctttcatccgccgccggcagcgtggttgtctgctcgaacggcgcgggcgtgccgttttccgaggaacaggccgctaaaatcctggcgcagccggaaatccgcattgagatcgacatggctcagggcggcgaaaccgccacggcatggggctgcgatctcacatacgattatgtgaaaatcaacggcgattaccgcacctgacggcgggggagggattcaagtgcagattgcaaatcaggagaaggcgcaggtcctcgcgcaggctctgccgtatatccaggcgtacagcggcaaggtggtcgtcgtcaaatatggcggaaacgccatgatcgacggccagctcaaggcggccgtcatgagcgatctggttttgctgtcgctcgtcggcatccgcattgtgctggtgcacggcggcgggcctgagatcaacgaggcgctgcgcgccgtcggcaaagagagccggtttgtcggcgggctgcgctacacggacgccgaaacgctgcgcatcgtgcagatggtgctggccggaaagacgaacaaggaccttgtcaacctgctggagcggcaggggggccacgcgcttgggctgtgcggcatcgacggcggcatgatccatgcgcagcgcgtgacaaaggacggcgaggacatagggtttgtcggcgaggtgacaagcgtcgatacaaagccgatcctcgacacgctcgaccgcggttatatcccggtgatcgccacgctcggttgtggcggcgacggcacggtctacaacatcaacgccgacgtggcggccgcgcgcatcgcggcggagctcggcgcggagaacctcgtttccatgacggatgtgcgcggcctgctgcgcgaccgcacggacgagggcacgttgatccccgaggtgcgcgtcagcgacgtgccgcagctcgtgcgccaggggatcatccagggcggcatgattccaaaggtggagtgctgtgtcgaggcggtgcgccgcggcgtgcgccgcgcgtttatcatagacgggcgcatcccgcactccctgctcatagaactgatgacaaacgagggcatcggcaccatgttcgtcggatgatgcccgggcttgccgctgcggcggcggaaaggcggttttgaaaatgggcgttgcacaacgtgatcaacaatatatcgcgccgacatacgcgcggtcgcccctggaggcggcctgcggcgcgggcgccgtctgcaccggcgcggacggacggcggtatatcgatttttcaagcggcatcggcgtcaattcgctcggcttctgcgaccccggatgggttgcggccgtcagcggccaggcggcaaagctccagcatctttcaaacctctactataccgggcccatggtcgatctggccgagctgctgtgcaagcgcacgtttgcaaaaaaggtattctttgccaactccggcgcggaggcgaatgagggcatgatcaaggctgcgcgcaaatacagctttgaccgctacggcaagggcaggcacatgattgtttcgcttgtcaattcgttccatgggcgcacgattacaacgctgtcggccacggggcaggacgttttccatcagtatttcgacccctttaccgagggctttcagttcgtcccggcgggcgatatcgacgcgttgcgcgcggctgtaaaggcgggcggcgtctgtggcgtgctgctcgagctgatccagggcgagggaggagtcgtaccgcttgacaaggcgtttgtcgacgcggccgcggcgctctgccgtgaaaacgacgttttgctcatggccgacgaagtgcagaccggcgtcggacgcacaggcaggctgctctgctgcgagcattacggcgtgacgccggatctcgtttccctcgccaaggggcttggcggcgggctgccgatcggcgcggtgctattcggtgaaaaatgtgcggatacgctcgggccgggcgtgcacggctcgaccttcggcggcaatcccgtcgcgtgcgccggcgcctgcgaggtgctgcgccgcctggacggcgcgctgctttgcgaagtcgaagaaaagggcgcttatatcacagagcgggtgcttgcgatgccgcgtgtcaaacgcgtcgacggcaaggggctgatgctcggcgtcacgctcggcggcatggacagcaaaacggccgcggcggcctgcctggagcatgggctgattattttgaccgcaaaggaaaagctgcggatgctgccgccgctgacgattacatatgcggaaatcgacgaagggctacagagtttaagagaggtgttgtcacaatgaagcatttgttaaagctgctcgacctttccggcgaacagattacggaactgctcaatctgggcgatcagctcaaatatgagcagaaacatggcatcgaccaccagaggttaaagggccagacgctcggtatgatcttccagaaaagctccacgcgcacgcgcgtatcgtttgaggtgggcatccaccagctcggcggcacggggctgtttctttcggccaacgacctccagatcggccgcggcgaaccggtgcaggatacggcgcgcgtactttcgcgctatcttgacggcgtcatgatccgcacattcgcgcagcaggaggtcgaggatctcgcaaaattcggttccattccggtcatcaacggcctgaccgatttctgccatccctgccaggtgctcgccgacctgatgacggtgcgcgagcataagggcggtttggcggggctgaagctctgctacatcggcgacggcaacaatatggccaattccctgatcgtcggcggtttaaaggtaggcatgaacgtgtcggtcgctacgccgaaggcgtaccagccggatggaacggtgctctcgttcgcgtcggcttatggcgataaattcagcctgaccgacgacatccatgcggcggcggccggcgccgacgttgtttttacggacgtctgggcgtcgatgggcatggagggcgaggcgcagcagcgccgcgcggccttcactggctatcaggtcaacgacgagcttctttccgtatgcgccagggatgttatggtgcagcactgcctgcctgcgcaccgcggcgaggagattacggagtccgttttcgaggcgcacgccaatgaaatctttgacgaggccgagaaccgcctgcacgcgcagaaggccgtcatggtcaagctcatggagaagcccccgcttttttgaaaaaaagctcggcaaaaaattttccggcctttttgaaaaaaggcctcagcgaaaaactttaatcggctgcgccgcgaacggcgggtttggcgctgcgtgaaaacaggctgtgccgcgaacagcggggcgctcgggcacgccttgtctttccggctggagcggcgcgcatttgacagcgatactctgataggataaaatgaggtacggaaacgcttaaaaaacgcttgaaaataaccctttatccagagaggtgccgatatgaatcatttgcgctgtacggcgctgctgcttgccgcgctgcttgcctgcacgctggcagcgtgctttggcggcggggagcgtggggaagcgtcctcatccccgtcgcaggcacggcaggaggagccggacccgaactggccggttgcgatcggagatatccgtgtggcggaaaagccggagcggatcgtttcgctttcgcccgcgttgaccgaggtgctctatgagcttggcggcggggaccggatggccggtgtgagcgcctattgcgactttcccgcggacatcggggacctgccggactgcggtacggcccagtcgcccgatcttgaccgtctgcgcgagctgtcgccggacgtggtgttcgtgtccgcgccgatgacgcaggcatatacggtcgcgctccagcagatgggcgcagaagtggttgtgctgccgcgcgccgattcgatcgatgcgctcgaaacaacgtatgtcacagccgcgacggtccttgacgggatgcaggacggcgacgaaaacggccggcgcgtgtttggcgcgctgcgcgcccgctatgacgcgcttacagatgccgccggcgggatagcagatcgtgtatccggcgtctatctgcgcgcggtccccctgctgatcgcgacaggggatacctttgaagggcagcttttggaggcaatcggcgtcgataacgacgcggccgcgtttataggctgggattatccagccgacgaggctgtcaacctttatccggacgtgatcttttacgattcgtccatcgatccggcgtattttgccggtacgcaggtttacagcacgacagacgcgtatcaaaacgggcggctgtacccggttgatgcggttgcgctggagcgccagagcgcgcgcatgtttgaggaattggagcggatgttcgcgcaggcttatcccgatgtatcggtcgggacgccgtccgctgacgatgagcaggccgtgaatgagcaggtggtttcctccgcgccgcaggcgggaggacaggccgcgtccggggatgagatgcttgatcttgatgacgcgacacaggttattgaataaaaaagcaggaaaaaagccggcccgcaaggccggctttttgtcagcggttgatcgtaatcgcgtcggaaaaatgatcaagcagcgcgagcgcctggttgtcatcccggtcggcgtccgccgcgagcatggcgatataaagggtgtcgtccacaaagaacgcctcgtaacgcgcgagggcgccatcatgataggcgtctgcaataatatacgcttgagtgccgtcgggtccggcggcgtccatatcataggaaagctgctgcctggtcagccctgattcaagcatttgtgtaaggaccgcctctttctcatcggcactcagaccagaaaagaggctgctgctggcgacacgatcaagactgacaaatgctttgcgcgacaagctgcgcatactctgtatgccgttggccgtactgacttcgggcgcgcttggcatcggtatggtcaccaggccgtccgcggtggtataggtatcccaggaggagatatcaaagctggcctgattttcctgaaggaaactgaaaactccgatagccagacaagccgccgcgagcagtgcgtaaaggatcatcccggctgaagcatgaaaacggccgcgtgtaaacagcgcggcaaccgtcgggttgggatcgctggaaaaacgccgcttataggaatggtattgaaacgcgccgataagccccataatcagcgcgtacaggataacgccgcgcatgatgaaataggcgatgttgccgcttttaagcaggccgggcaggtcggaaagggcggtatccacaatcatgaacacaagtccgatgacgacacagacgcggcttttataatggataccggcggcgacaacaaacataataaagccaaccaggcagtaaaaccagccgaagccgccgaattccaagctgtccagaataccgggcgccaaagccgtggttgcaccgatcagcgtattgaccacggcgacgaaaacggcggccccgaaagccgacgcaatcatgcggtgatttttgttcatcagcccggacagcctgtttgcgcgcacatcgtcggacaggaccggggtgtttggcgatttatccatccgttattcacctctctgttttttgccttgtaggattcaggtatttttccttattatagcagagaatacggctggacgcgaggctttttcccattttatataaaccctggcggttctgcgggttgacgcggcctaaagcgcgcgcgtataataaaggttatccaaccgtgctgtccgagagatttgaggaagatacggggtttcatgaccgatcagaggaggtgccggctatgatcatcagcggtgcgcaggcaatggtaaactgtcttgaggcacagggcgtaagcgtcgtgtttggatatcccggggcggcaatctgcccgttttatgactgcctggcgcagtccgggatccgccatatcctggtgcgaagcgagcagaatgcaggacatgcggccagcggctacgcgcgtgttgcaggcaggccaggcgtctgtatcgcgacaagcggccccggcgcgaccaacctgcttaccgcgctggctacagcgtatgccgacagcattccgcttgtggcgatcaccgggcaggtggaaacgggactgcttggccgcgacgtattccaggaggtcgatacgaccggcgcagcgtcgccgtttatcaaatacagctatctggtcgaggatgcgagggatattccgcgcgtattcagggaagccttttatatcgcttcgaccgggcggccgggtcctgtgctgatcgatatgcctgtcgatatccagcgcgcgcagctcgactttgcctacccggagacggtttcaatccgcggatataagccccgtatccaggggcatgccggccaggtggaacgcgtggccagggcgctttgcgctgccagacggccgctgctcgtcgtgggcggcggcgcggtcggagcgcgcggcagcgtgcgcaggctgtgcgagatgtgcgggctgcccgccgtttccacgatgatgggcatcggcacgctgccgtcgaagcatccgctttatttcggcatgctcggacagagcggcgcgccggccgccaacgaggcagtcggtcagagcgatctgctgatgatcctcggcgcgcgcgcggacaaccgggcgatgggccggccaggctgtttgggcgcggataagacggtgattcacatcgatatcgatacggcggagatcggtaagaatgtcggcacgacaatcccgcttgtcggcgatgcggcggcggtgctcgcgcagctgtgcgagcggcggccgcatggcgactggcaggaatggaccgcatggcttgacagcctgcgggactgcccgcgggcgcctgccgaggccgccggctttattgacccggaggcgtttgtacggctgctctcgcaggagctggacggcgatgcggtttatgtttcggatgtcgggcagaaccagatctggtcggcgagaaactacgatgcgcgcggcggcctgtttttgacgacgggcggcatgggaacgatgggatacgcgctgccggccgcgataggggcgcgcctggccgcgccggggcggcaggttgtggctgtctgcggcgacggggcgtttcagatggaaatgatggaactggcgaccgccaatcagcacggcgtaacggtcaagctggtcgtgatgaataatcagatgctcggcatggtgcgcgaaattcagcatgacggctatggcgggcgcgaaacagccgtcgcgctcggcggcgggccagggctgtcaaagatcgccgaggcataccagattcgatatctccgccttgacgcgatggagaacgcgcgcgaaaccgtgcgcgcctttttaaaaacggatgattcctgtatcctggagtgcgccgtggacccgcgcgcggccacacattgagcggaaaggggcggtcgtgatgaaggaaatcatatcggcgctggttgagaacaaggcgggcgttttatcgcgtatggcggggctgtttgcgcggcggggctttaatatcgcaagcctggccgtcggcgagacggacgacccgaccgtatcgcgcatgacgattgtggccgagggcgatgaacgcacgatagagcagatcgaaaaacagctcaataaacagattgatgtgatcaaggtgcgcgttttggagcacgacgcttccacacgccgcgaattgattttgattaaaataaacgccgcgcagcagacgcgcggcgaaatcatcgatattgcggcgatcatggacgcgaagattgtcgacctgtcgcgcaccaccctgacgatcgagctgtgcgaccgcccggagcgcgtcgatctgctgatcgatatggtgacgccttacggcattgtcgagatcgcgcgcactggcatgattgccctgcaaaaaggggtcggaggtatcggcgggcgataacgcggcgtctgatttgattgcgcagcggcggcgcctatatcaacgcagcacccggcccgctattcgcggcgcagccgattaaagttttttggcttacctttttttcaaaaaaggtaagtttcaaaaaaggtaagtttcaaaaaaggcgggcgcggatggaatagatgggttggccgagattggaaaaataggtttcatattcggtcatgatgttgccggcggcatattcgctgtgatgcaggtcgtcggtggagaaatagcggtccatgcaggcgtcgaattcaaacgttgagaaatggtacagcatgtagttgtcggtcttaaaccagatttccccgtccggctccagcagcgtcttatacatctcaaggcggccgcgccaggtcagcctttttttatactgcctgcgcttatgccaagggtcgcagaaattgatataaatgcgtgaaagctctcccggttcaaagatgttgggcagccggtccgcgtcgcccaaaataaaatacagattcggcagcggcgtcaaaagcgcctgttccatcgccgttaccatgacattcggctcgcgttcgaccgcgataaaattgcattccggatggcgggcggccagtgtgcggataaaaagccccttgccgcagccaagctccacatgcaaaggccgcgacggatcggcgaaccgttcacgaatgcgccctttttcagattcaggctctaatatggtgattgcttcacaggccgccagccgcggcgcaagattatgtttttttcttggacgcatgattgctgctcctttattacaaattgtataaaactctaaaaaatatccgaattggccgcaagaacatcgtcggccagacgccgggcgtcgtcaaaaacggtgagcgccccggcctgcttgcggaaggcggccgcgccgcgcatccctttcatgtaccaagccgcgtgcttgcgcgcttcgcgcatagcttggcgctcccctttgttttcgcagatcagggaaatatgccggagcataacatccatacgtgtttgcaggttgggcgtgggcaatgtgacaccatcttttaagtagcgggcaacctgtgaaaagatccaggggcttccaagcgcgccgcggccgatcataacgagatcgcattttgtataatcgtacatattaacaacggattgtatatctatgcagtcgccgtttccgatcaccgggattgataccgcagccttaaccgccgcgatgatgtcgaggtcgacaggcggcgcataatactgcatccgggtgcggccgtgaaccgtcagagcagccgcgccgctctgttccatcgcgcgggcaaattcgacggcgttgacgtgtgcgtcatcccatcccttgcggaatttgaccgttacaggcaagtcaactgcctttacagtcgcttcagtgatgcgcgcagccagcgccacatttttcatcagcgccgcgccgccgccattaccggcgaccttaggcgcgggacagcccatattaatgtcgatgacatccggacaaaacgcgagcgcctttttagccgcctcggcgacaatctccggttcatcgccgaatagctgcactgcaacaggccgttctacatcgtttacgccgagcagcctggccgttttgcggtcggaataatgcatccccttggcgctggccatctcccctaccatataggccgcgccgaattgcttacagatctgccggaaggcgctgtcggccacgccggccatcggggcgagcgcggcggtgcgttcaatttcgattttaccgattctcaatggataacctccgggaaaaaattcatggttcacatgcaatatcttaacagaaatttgaccatgaggcaacgttttgtggtatactaataaaacatgcaaaacataaaaacgattggacaaaagctgcctgtacgggcttcggacgcggctggatggaatgagggggtggccggcagtgaaattactggcggttgatggaaacagtatattaaacagagcgtattatggtatcaaggcgctgacaaccaaaaatggtgaatttacaaatggtatctatggttttttaagcattttgctgcgtgtactcgacgaggccgaaccggatgcggtggcggtcgcgttcgatctgcgcgcgcccaccttccggcacaagctgtatgacggctataaggcgcagcgcaaggggatgccgcatgagctggcgtcgcagcttgagccgctcaaggagctgcttggcgcgctcggctttcagattgtaacctgcgagggctatgaggcggacgatatcctcggcacgcttgcgcgcagcagcgccgaaacgggatgggactgcgtgattgccacaggcgaccgcgacagccttcagcttgttgggccgcacgtatcggtgcggctggccacgacaaagatggggcagcccgcctcaacgctgtatgatgagactgcggttcgtgaaaagtatggcgttgaaccggcgcagcttgtcgacgtcaaggcgctgatgggcgatgcgtccgacaatatcccgggcgtcgccgggatcggtgaaaagacggcgctgtcgctgatcgggcagtaccacgatatcgatgcgatttatgcacagctcgacacgcttgagatcaagccgggtgtgcgtaaaaagctcggcgagggcaaagagatggcatatacgagccgaaagctcggtgaaatctgctgcgatgcgcccatcgacgcttcgcccgcggcataccggcgcgcgccggttgatcaggcaaaggcagccgcgctgctcgcacggcttgagatgttcaagatgatggagcgatggggcgtcgacccggcagccgcgcgggagacggcgggcggcggcgccgcgccggaaacggcgcgggagccgtccaggccgatgcgggccgaagccgacgcgcccgatcttgcgcagcgggtgatcaaggcgggggcggccgatttggcgttcggcctggacggcaacggcgacatcgctgccgtcgccgccgccctgcctgacgggacgctgctgctttccggcggcgagacgctcgaaccgctgcttgccgccggtgtgaagctgcgcgtatggagcagcaaaccgctgcaccgcatggcgtaccggcgcggcgtgcatctggaaaatgtgacgtttgacggcgagctggccgcctacctgttaagtccgacaagcgccggctatgaccccgttcagctctgcgcgcagtatgcgactgaaacgcgcgcgctcgaaggcgaaatcccggagcagtacgccgcgcttgcggcgcaggccgcggcgctgtccgcgctgcttgacaagctgacggatgaaattcgggaacatgagcaggaaaagctgctttatgagattgaaatgccgttggcgcgcgtgctcgcgggaatggaatgcgagggcttcgcgctcgatacccaggcgctcagggactacggcggcgagcttgacgaccggatcgatgagacgcacgcggcgattgttgaatacgcgggctatgacttcaacctcaattcccccaaacagctcggcgacgtgctgtttgtaaaactggggctgccagcgaagaaaaagaccaagactggctactccaccaatgttgacgtgctcgaggcgctgcgtccgcagcatccgatcatcggggagatattggagtaccgcaagctttccaagctcaaatcgacctatgtggacgggcttttaaaggtggtcggtccggacggccgtgtgcggtcgaccttccagcagaccgagacgcgcaccggtcgcatcagctcgaccgaaccaaatttacaaaatatccccatacgcaccgaggagggcagccggatgcggcgctttttcacagcgcggcccggttggaagctggtcgacgccgactattcgcagatcgagctgcgggtgctggccgacctggccgatgatcagaatatgatcgcagcattccaaagcggcgaggatatccatgccacaacggcggcgcaggtgttcgggatgccaggcgggacggtcacgccgctgatgcgttcgcgcgccaaggcggttaattttgggatcgtctatggcatcggggcgttttcactgtcgcaggatatcggcgtcacagtttccgaagccgacagctatatcaaaagttatctggcccactacgcgggcgtgcgcaaatacatggaggataccatcgcctttgcgcgggaaaacggctatgtcaagacattatttggccgccggcgctatctgccggagcttgccgcatcgaacaaggtgacgcaggccttcggcgagcgcgttgcgcgcaacacgcccatccagggcacagcggccgacatcattaaaattgcgatggtgcgcgtgtttgaacgcctgcgccgcgagggactgcgcgcgcgcctgattttgcaggtgcacgacgagctgcttgtggaagcgccggacgatgaaatcgaccgtgcgcgcgccatcttgaaggaggaaatggaacatgccatcgcgctcaaggttccccttgaagcggatacaaacgtcggggacaactggcttgcagcaaaatagacggcggctttggccgcgccggtttttggaccatccatgcgcccgcttgcgcgcggtgcgctgccgccgtatgacggcggaggatatcgcgggtgtggcgtcgcttgaacgggcctgcttctcacagccgtggagcgcgcgtgtgctggaaacagagcttgcaaacccaaacgccgtctttttcgtggctgtatcgggaacgcgggtgctcggctatgtggggatgcaccgcgtattggacgagggctacatcgccaatgtcgccgtcgccgggccgatgcggcggcatggtctggccacacggctgatggagatgctgttcgctttcgcacgccgcgagcggctcggctttatcacgcttgaggtgcgtgaaagcaacgcgccggcgatcgcgttttatgaaaaggctggcttcggcgttgcggggcgccgcagacgctactatgccaacccgacagaggatgccgtgctgatgaccgcttttttaaccgcggcgcagcaggggtgcgggagggaaggcgtatgaacatattggcgattgaaagctcctgtgacgagacggctgcggccgttgtgacggatggacggacaatccgttcgtccgcaatcgattcgcaggtggcggagcaccggctctacggcggcgtcgtgccggagatcgcatcgcgccgccactgtgaaaacattgttcctgttgtagagaaggcgctcggcgatgcgggctgtacgctcgcggggatcgacgctgtggccgtgaccgcggcgcccgggctgatcggcgcgctgcttgtcggcgtcaattacgccaaggggcttgcgtatgccgcagacaagccgctcgtgccggtacaccacatccgcgggcatatcgcggcaaactatctggcgcatcccagcctggagcctccgtttctgtgccttgtcgtctcaggcggccacacgcatattgtacgggtaaacggctataccgattttcaggtgatcggccgcacgcgcgacgatgcggccggcgaggcgtttgacaaggctgcgcgcgcgatgggctttgcgtatccgggcggcgtatatatcgatcaggcggccggccgcggcgatccggaccggtaccgcctgccaaagccgcgtgtcgacggcgcgccgtatgacttcagcttttcggggctgaaaacggctgtgatcaaccttctgcataacgcgcgccagaagggagagactgttgatatcgattctttggccgcgtcgtttcagcgcacggtgtgcgaagtgctgacggacaagctgtgcgcggccgcgcgcgcatacggctgcacaacaatcgccgcagccggcggcgtcagcgccaacagcggcctgcgcgccgcactggagcagatgtgccgcgcgcagggctggcagtattttgcgccgccgctttcactctgcggggataacgccgcgatgatcggcgcgcaggcgtattacgagtaccaggccggcgtgcgcgcgggcgcggacctcaatgccgcgccgtcgatggatattgccgaaggctttgcgcaggcgcgcgcgcagcgggcctttggcgtcccgtcccggcctgcgggcagtgcggtttgattaaaatggctatgaccgggtttagcagagtgcagcgcaatctataaaaaaagaggcggtgtcggcggcgatttttgtggcggttgcagatattgacgaaaatttaacagaaagcgcgtcaagcgccttgcaatcggcctggacgaggggtataatgctaaacgtgggagatttcggattttctggaatagagccgtgaaaggccaaagaaaaccggttttccatttttcttgtatcgttttaaaaaccgttccaaatacattgagaggagtaaaagcatgaccaacaacaaaaatgtcctcaactggattgaggaaatgaaggcgcttgtcgaacctgacaaggttgtttggatcgacggaagcgaggcgcagcttaaagaactgcgcgaccaggcgctcgccaccggcgagatggaagccctcaaccctgaaaagctgcccggctgcctgttgcacaggacggctgtcaacgatgtcgcacgcgtcgaaggacgcacgttcatttgttcgcgcaaaaaagaggacgccggcccgaccaacaactgggaggacccaaacgtcatgtacgacaagctgcgcaagctgtttgacggcgcgatgaagggccgcaccatgtacgtcatcccgtattgcatgggcccgatcggctccccgttctccaaggtcggcgtcgagctgactgattcgatctatgttgtgctcaacatggatatcatgacccgtatggggcagcaggcgttcgaccagcttggcgagacatccaacgattttgtccgcggcctgcactccaaagcgcagatggacgaggaaaaccgctatatcgtccagttccccgaggacaacaccatctggtccgtcaactccggctacggcggcaacgtgctgctcggcaagaagtgcttcgcgctgcgcatcgcctcgtatcaggcgaaaaatgagggctggatggccgagcatatgctcatccttggccttgagaacccgcagggtgagatcaagtatatctgcgcggcgttcccgtccgcctgcggcaagacaaacctggccatgctgattccgcctgagaagtttaagaaggctggatacaaggtctggactgtcggcgacgatatcgcctggctgcgcatcggtccggacggccgtctgtgggcgatcaatccggaaaatggtttctttggcgtcgcgccgggaaccaacatgaaatccaatccgaacgcgctgatctccacgcagaaaaacacaatctttaccaacgttgtccacaaccttgacgacaacactgtctggtgggagggactcgacaagaacccgccgaagaatgctctcaactggaagggcgaaaagtgggactgcaccgacggaagcaagggcgcgcatccgaactcccgcttcaccgcgccggcgatcaactgtccgtgcatttcctctgagttcaataatcccaatggcgtgcccatctccgcgatcatcttcggtggccgccgcgccaagaccgctccgctcgtctatcaggcgcgcgactggcagcacggcgtgtttgtcggctccacgatggcttccgaaacgacagccgccgcggctggagcggtcggcgttgtccgccgcgacccgatggccatgctgccattctgcggctacaacatgggcgactactgggcgcactggctcgaaatgggcaagaagctcggagacaaggctccgaagatcttcaatgtcaactggttccgcaccgatgacgaaggtcatttcatctggccgggcttcggcgacaatatgcgcgtgctcaactggattgtcgaccgctgcgagggcaaggctgacgctgtagaaacgccgatcggctacgagccgaagcccgaggacatcgatgtggaggggctggacattacgaccgatacggtccgcgatctgctttccgtcgataagaacctctggaaagaggaagtcaagggcatcaaggagttctatgccaaatttggcgacaagctgccgcaggcgcttgaatctgagctggtaacccttgaaagcaacctgaacaagtaagcctatgcgtagcttgaggctttttaatccctggcgcggtattacggctgtgacgctcgttattatgggcgcatccgtcgcaattacctgtggagtgatggcggctgtcctctttttgaaggaccgctgaaccgtctgggagaagaatataaaaaaaccgccgcagcttttgccgcggcggtttttttatagactgcgaagcgcaaatctataaatatttggccatccgcgccggagatgcacggaggggttggattaaaatgcgcatctgcccgcaaagcgggcggatgcgcaaaaaaataattgctttacagctatattttatcggaatgtgttgacaactccaaaatttagattataataatagtaatagttattaatttttaaggaggaggcatacaaatggacttaaaggggacgaagacagaacaaaatgttaaggcagctttgatgggggaatcggttgcccggaacaagtacacatattatgcggatcaggcgcgcaaggagggcaatcaggagatcgcggctctgttcgacaggatggcgggcaatgagtctgtccatgctaagatctggttcacaacgctcaacggcgcgatcaagggcaatttggaaaacctcaaggatgcggcggcgggggagttcggtgagtggtccgatatgtatccgcagttcgccgcggtcgcccgtgaggagggctttgaacagcttgcggtgatgtttgaaaaggtggcggaaattgaaaagaaccatgaaaaacagtttatggaggcaatggtccgcctgatgaaaagcggtaaagagtcgccggctgccggacagaaggagcaatccgtcaagcctgcacagccggtgaagaaaaaacacggatatcgctgcatgttctgcggcgcgatttatgaggatcgcttggatgtatgtcctgtctgccaggcgatcggctcctttgaggactgtgaaatactcgcgtaattaaaatatttaaaacggggcggctgcaggccgtcccgtttttttgatcaacgtatgggcttattgatttccgtatgccttaataacgccggacgaccatgtcaggagcgattctgaagccgtgtcgaagccggccgccgcgccgcgcgcatgggtaagcagcgcgcgctcatccccctccagtacgctggccagatcagaatgtcttttaatatatgtgcctgtttcataataatgcttggcctggagggtgaatacagccgctttcaaaagcgcgcgtaaaatttccgggtccttttcatgcagaacattgtgcacacagccgtgataaatagtgcaggcgccggtcagaacggctctttggatatcctcgcgggcgatcagaggacgcagaaaatccaggctgccatacaaaatggccgtgtcatggtaaaattggaacagctccgagcgatcccaccgcgccagctcgtcccggcccgagacaaatccgcaaatcagcgagcggcgcggcagttttgaaatagcgtcgtcataggcctttaaatcgtggtatgacagcgtatcaagaataacaacgacgtcgatgtcgctttgttcggccgcttcgccgcgcccatggcttccctgaatgccgatggcttcgacacgcgcgccaaaggtttgccggacggctgctgtaaactgctcaagccagagcttcattgcttgttccatgctcattactccatttcggttatatgtgttcgccgatgcagggcggcgctcctgtttgcgcgcaacgccgtctttcgtatgccgtgggcctgcaaaatgcgcgccagccgcgccgcgtctgtcacgtattctgctgccgggcagcgcttcgtctgaacaggattcttgcggcctgtatacgtgcagcgcgcgccctattattcgcggcgcagccggtataaacgcagtaccaaacgcactgttcgcggcacagccgactaaagtttttcgccgaggccttttttcaaaaaggccggaaagttttttggcttacctttttttcaaaaaaggtaagtttcaaaaaagtgggcgaggttgtcgggggtgtcgtcgccgggaaggatgacggaagcggcggtttgataggcggcgcggcgcgtctcaaagagccgccgcagctcattgggggtactgcggcggacaatggggcggtcgctgtccctgattcgctcgtaacagacttcaaacggtgtgtcgagaaagacgatgcggtcgtagggagagacggccgaaacattgcgcgggaacgtcatcgcgccaccgcccgtcgacacgatgcagccgatgcgccgggcgagcgcggcgacagccgcgtgctcgcggtcgcggaattcctgttcgccgaaccgctcgaacagttccggaatggtcatgcccgcttccagctcaatctcatggtcaagatcgatgtattcgcgcccagtcaaagcggccagccgctttccgaccgtcgttttgccgcagcccataaaaccgcacagcaggatattgttcatagtccgcgctccttttccgtgagcgcccgctccatatccgtgatgatacgcgcgatatccgcctcctgaaaatgcgtgccgtgccagcgttcatgagcgatcgccgcctgccagaccagcatggccatgccgccggctgtttttttgccgtatgcgcgtgcgcgcccgagcaaaagcgtttcagaagggttgtacacacagtcgaacaccgcgtccacaccggcaagaaagtccccggaaaccggacacgcatcaattttgggatacatgccgacaggcgtgccgttgatcacaaggccgtaatgtccgcacagctcggaaagcgcgcatgttcgggggcgtttgccacagagcgtttcgatttcagaggcgagcgtttgcgctttatccaggcttgtcccacgcacggcgattgtaacaagcgcgccgcgccgtgcgcattcgattgcaaacatgcgccccacgccgcccgcaccgagcacgcacacggaagtttccagggcgatgttggcggcctgcatcgcacgcaaaaagccgttgcagtcggtgttgtcgccctcggtatggccgtcactgtcgatcgagacagagttgaccgccccatacagacgcgcgttttccgtgagtgaatcgatcagcgggatgaccgcgcgtttgtgtggaatcgttacgttgaaggcccgcagatgccggcgtagcagcggcatctgcgcggccaaatcttcaggcgcaatgtcggtcagatcatagcgcgcatcgatgccctcgagcgcgaacaggcgcgcgtgaatctggggggaaaacgaatggccaagcggatggccgatcagggcgtaagactgcatgatgatacctcctcgatggtgtcggaccggacagaaagaagggacgccgcgcgggcgtcccttccggactgtcttgaaattaaagcgtctccttgagcttttcgacggcgctcggcttttcgacattgcaggcggaaacctgcttaaagccgcgcttgatcagcgaggtaagcaccttgttcgggccaagctcgatgaacaggttgattccttccgcaaccatgccacgcacctcctcgtggaagtggaccggcgagatcaggtgtttgacgagatactcgtgcaggtcggcgtcggcggggagcatatggccggtcagattggaatagaacgggatgcacagcgggttcatgcgcacaccggcgatcgcctcggaaaattcctcggctgcgctggacatcagcttggaatgaaacgcgctggaaacagcaagcttcgtcgtgcggaagcccatgccggcgagcgtgtcggcggcggcctgtgcggcggcgctttcgccggcgatcacggtctgggtggcgttgttgtagttgaccggcagcacatagccggccgtttcgcggcaaacgcgcgcgatggtttcctcatcgctgcccatgatggcgaacatgctgcccggattgcggtcagccgcacgctgcatggccgcgccgcgcgccgcaatcatcttaaagccgtcctcaagagagaaagcgccggctgcggtgagcgccgcgtactcgccaagcgagtggcctgcgacagcttccggctcgcacagttcggacacgacggagtaggccgccatggaaacagcgtaaatagccggctgagagatcttggtctgtgccagcgtggctgcgtcgccctcgaaggagagcttggcgatgtcaaagcccaggatgtcgttggcgcattcataaacattgcgcgcggactcgaagttctcaaaaagctcgcggcccatgccgggatactgggaaccctggccgctgaaaacgaaagcaagtttgttcatctcaaataatccccctgtgcgtacaaattagattgtctttttttaaatcttttccattaaaagaatttttaacaattttatagttgacaaattgtgtctgatgcctgtatgatagcaattgtgaaatataacacttgttacatttcggactcattataacacaacaaaaatccggatgcaagagggaatttgcaatcggtggggagaaaacatgtcaggtattcaaatatgcggaacgggccgctgccttcccgaaaatattgttgataataacgaatatgccaggattgtggacacctcggacgagtggatcaggccgcgcacgggcatcgtaacacgccatattgccgacggtgaaaccacatggaggctgggagagcgcgccgcgcgccaggccattgaggacgccgggatttctccggagcagattgggctgatcattgtatcgtcagtatcggctgattttgcaacgccctcgatgagctgtatcattcagggttcgatcggcgcgaaaaacgcgatgtgttatgatatcgcgtgcgcgtgcgcgggatacgtttacgggcttgatatggcgcggcgctttcttgcctgcggcgatattgattacgcgctgatcgtaggaacggaaatcctctcgcgcctgactaattatgaggaccgcagcacatgcgtgctgttcggcgacggtgccggcgcgacggtggttcgcgcggcagacgcgctttacggcgcttcgcttggcgcggacgggaccggctacggcctgatgttctgcaaaaacccgccgcccgcctcgccctttacccacaacccgccggagcaggacgctgtttacagccgtccggaaggtcccgggcatatggtcatgggcgggcgcgaggtctacaaatttgcgacaaaggtgatgccgcagtcgctgctgcaagcctgtgaaaaagccggaattcaggccggggaacttgattggattgtgccgcaccaagccaatgtgcgcatcgtccagacggcgatggaccgcttgggcctgccgatggaaaaagcgtggatgaccatcgaccatacgggaaacacctcgtccgcgtcgatcccgatcgctcttgacgagcttcaccgcgccggacgcgtcaggcgcggagacaagatcggcctgtctggttttggcgccggcctgatctacgccagcctcgtctttgagtggtaaacccgtttgtgccgggacgatacacgggcgcggttcgccgctgcaagggctgatattttgcagaaacggcaaaatatcgattccttctggacagcacaggcgcgcgcaggtatgataaagtaaaaagctttcgacataacgattggtttgatccaaaattttgcatcggcaagaagctttggacagtcatttatgattccccgcgcgcagcggcgctatgcctgtcaaactaaggcgcgctggccgggctggaaaaccatgtggccaatgacagggaggatttaacatgttgaaaacaaagataaccgaaatgctcggtatccggcatccgctttttcagggcggaatggcctgggtggccgacgcgaagctggcggcggctgtttccaatgcgggcggtttggggctgatcggcgcggccgccgcgcccggcgacgtggtgcaggccatgatccgcgaggcgaaatcgctcaccgataaaccgttcggcgtcaatgtgatgctgctcagtccgtttgccgacgatgtcgcgcgtatctgcgccgaggaaaaggtcgcggtcgttacgacgggcgcaggcaaccccggcaaatatatggatatgtggaaaggcgtcgatatcaaggtgatcccagtcgtggcttccgccgcgctggccaagcgcatggaacgcgcgggcgcggacgccgtgatcgccgaaggctgtgaatccggcgggcacatcggcgaactgacgacaatggcgcttgttccgcaggtcgcggacgcagtaagcgtgccggtcatcgcggcgggcggcattgcggacggccgcggcgtggccgcagcgttcgcgctcggcgcgcaggcggtccagtgcggcacggttttcgtctgcgctgaggaaagccccgcgtgcgatgtttaccgccggcagatcatcgacgcgaaagataccgacacgattgtgacgggccgcgagggcggcgcgccgattcgctcaatcaaaacgaaatttacgcgccgcctgctcaagatggaaaatcagaatgttgaccgcgtcgaatttgagaaggcggccgcgggttccctgcgcaaagcggtgcaggacggcaacctcgacgaaggcacgtttatggccggtcagatttcggggcttgtcaaggccgtcgagccggcgcaggcgattgttgaccgcctgatgcgcgagggagaagaactgatgaaaaacctgttttcagaaaggggcattaccattgaataagacagctttgattacaggcgcggcaaccggcattggacgcgccattgcgctgacgcttgcgcgcgacggctttgacattgcgatcaattgccttgacagcctgctgccgcaggcgcaggctgccgcggagcagtgccgcgcccacggcgtacaggcggagtgctttgtcgccgatatctcaaaatttgacgaatgcgccgcgatggtcaagtcggtccacgagcgttttggcagcatcgacgcgcttatcaataacgcgggcatcacgcgcgacggcctgatcgcacgtatgagcgaggagcagtacgacagcgtcatcgccgtcaaccagaagggcgtgtttaacatggtgcgccatgtcacgcccattatgatgaagcagcgcagcggccgcattgtcagcatggcgtccgtttcgggactttacggcaacgccggccagtttaattactccgcttcaaaggcagcgatcgtcggcatgacaaaaacggcggctaaggaacttggaggccgcggcatcacggtcaacgcgattgcgccaggcttcatcgagacggatatgaccgccaagctgcccgacaaggccaaggaagcgatcctttccggcgttgcgctgcggcgcatgggccgccccgaggatgtcgccgaggcggtcgccttcctcgtcagcgaccgcgcttcctacatcaccggccagatcctcgccgtcgacggcggcttttagcccgcttttttgaaaaaaagcttggcaaaaaactttccggcctttttaaaaaaaggcctcggcgaaaaactttagtcggctgcgccgcgaacagtggtgcaggtgctgcgtttatacaggctgcgcccccggcctttcaacagacggatcgattatattttcggggaaagacccaaaatgaagaaaagcagggccgcgcgcggcggggagaaacggcgtgcgacggagctgaaaggagagcggatatgaaacgagttgtgattacctcgacaggcgtcgtttcgccggtcgggctggatacaaagaccttctgggacagcgttgtgaacggcaggcacaatttcaaacccattacgtcgttcgacacgtcggcgctcaaagtgaaatgcgccgcgcagatcgacgaatgggacccggtggcgatgggactcaacaagaaggaagcgcgccgcatggaccgtttcacacagtttgcaatggctgcggccaagcaggtgatggacggcgcgggcgacctggggaaatttgacccgtttcgcgcgggcgtgattgtcggcagcggcatcggcgggtttcagacgacgctggccgagcacaagaaatttcttgagaaagggccggaccgcgtgtctgtattcatgatcccgatgatgatctgcaatatggccgcgggacagatcgcgattgaatatgggtttaagggcgataattttgcagttgtgaccgcctgcgccacgggcaaccactcgatcggcgaggcgtttcggaagatcaaatacggctatctcgacctggcgattgccggaggcacagaagcgccgatcaacgatgtcgcgatcgcgggcttttacaatatgcaggcgctttccgacacggccgactgcgaccggctgtgcatcccgttcgataaggagcgcaacggctttgtcatgagcgagggcgcggggcttgtgatgctcgaggagcttgagcatgcgaaaaagcgcggcgcgtcgattctcgcggaggtcgtcggctacggggcgacggacgacgcctatcacatcactgggccggaccccgagggcatgggcgccgccatggcgatgaaaaacgcgctggcggacgcgggcgcagcgcccgaacaggtcgcctatatcaatgcgcacggtacttccacgccgctcaacgagcagatcgagacgcgcgcgatcaagaccgctttcggcggccatgcctacaagctggccgtcagctccacgaaatccgtcaccggccatatgctcggcgcggccggcggcgttgaggccattattacggcgcttgcgctgcacgacggcgtgataccgccgacgatcggctacaaggtgccggatgaggactgcgaccttgactatgtcaccgagggcgcgcggcgcgttgattttgaatatgcgatgtccaattcgcttgggttcggcgggcacaatgcgagcctgctgctgaaaaaatacgagggctgaaacagcctgtaatcatgacgctgaggcaggaggcatacaatggcattgcttgacaaaaatcagattatggaaatcatcccgcaccgcgacccgtttttgctgattgacgaggttgaggaacttgaaatcggaaaacgcgtcgtggcaaaaaaattcatcgcgccggattcgttctggttccggggacactttcccgaacatccggttacgccgggggtgctgatcgttgaaatgctcgcgcaggcgggcgcggtctgcgcactggctatgccggagaacaagggtaaaatcgcatttttcgccggcatcgacaaggcgaaattccgccgccaggtgctcccgggcgacacgcttcgcctggaggttgaaatgctaaaggtgcgcggcagttttggtgtcgggaaggccgtcgccacggtcgacggggaacgcgccgtgacggccgagatcacgtttgcgctcggcaaatagcagcgctgcgccggttccttgtgcacgcccgccagattgacaggccgggaaaatataaatttatgtataaatacctattgccaaaccgtggcaaaacaggtatgataaaattcgtcggaaacgggacggcgcgcggcgcgccgctccatgcgtctgaaataaagattttttaatttaaaaaagtatgttcaggaggctgctaattatggtattcgaaaaagtaagggaaattttggttgatcagctcgatgtggatgaggatgccgtcacgatggaagccagcattcaaaacgatctgggcgctgattcgctcgacatcgtcgatctggtgatgtcgctcgaggaggagttcgactgcgaaatccccgacgaggagattgaaaacatcaagacggtcggcgacattgtcaaatacatcgaggaccatcagtaagacgcttgtctaaaagcccccgcagcggcgggggcttttatatacaccgcggcgatttgccgcggagggcgccgggacgcttgcaattgcaggtgttttcggctatgataggagcaaagacttttgccggcgggaccggcgacagatatggagggagtgtaacatatgtatacgaacggaaacgcggatatgtcctatgtggagaccaacacaaaaagcccgctttataagcacgtggccaagacatacgcctggatgtttttgggactgctgctcacctttttgacctgtgtagcgctgtacgcgacaaaactggtcatcgcgctgtttatcacatggtggctgccgtttgcgcttttggtcgcaaagctggcgctcgttgtctttttgacggcgcgccttcacaaaatgtccgtcggcgcggcgcgcgggatttttctcggcttttctgtgctgactggtgtgacgctttcgccgctgatgctcatgtatgaggccggctccgctattttcctgtttggagtggccgcgctgtttttcggtgtgatggccggggccggcctggtcaccaagcgcgatgtgtccggctttgcgccgattgtgctgtttggtctgatcgcgctggtcgtcatggagcttgtcagcctgtttattcatatgccaatgctcgatacggccatctgctttattggaatcgcgatctttctgggcgtcaccacctatgacgcaaagaagtgcaaggactattactatgcttacgagaatgacgcgcagatgcttgacaaagtttctattttttcggcgctcaatctctatctggattttatcaatctgtttttgtatctgctgcgcctgctcggcaaacgcagataacatcattgtgtggcgaaggagttcataacgaatggcggaccagaaaaaaatggtggaagcgattacctcaatggacgaggatttcgcgaaatggtatactgatattgtaaaaaaagccgatctggcagattattcatctgtgcgcggatgcatgattgtacgcccttacggctgcgcgatctgggaaaatattcagcatatccttgacacgcgctttaaagagctggggcatgagaacgtgcagatgcctatgtttatccccgagggcctgctccagaaggaaaaggaccatgtcgagggctttgcgccggaggtggcctgggtgacgcacggcggagaggagaagctgacggagcgcctgtgtgtacgccctacctctgaaacgctgttttgcgagcattatgcaaagattatcaattcataccgcgacctgcccaagctttacaatcaatggtgctccgttgtccggtgggaaaagacgacgcgtccgtttctgcgcacctgtgaattctggtggcaggaaggccataccatgcatgagacgcagcaggaggcgatggaggagacagagcggatgctcggcgtttacgccgagttctgtgaaaattccctcgctatccctgtgacgaaaggccgcaagacaaaaaaggagcagtttgccggggcggaagcgacctacacgattgaagcgatgatgcatgacggaaaggcgcttcagtcgggcacgtcgcattacttcggcgacggcttttcccgcgcgttcggcattacgttccaggggcgcgacaataagccccaatacccgcatcagacatcgtggggcatgtcgacgcgcatcatcggcgcgatcatcatgacgcatggcgataacgacggacttgtgcttccgccggctatcgcgccggttcaggtggttgtgctgccgatcgcgcagcacaaggagggcgtgcttgaagctgcgcgcgccgtgacggagcgtctgagaggcgtctgccgcgtgaagattgatgacagcgacaacagcgccggctggaaatttgccgaatatgagatgaagggcgtgccgctccgcctggagatgggaccgcgcgatatcgcggcgggtcagtgcgttgttgtacgccgcgacaaccgtgaaaagacggtcgttgcgcttgacgagctggagcagaggatacccgagctgctgcgcgcggtgcacgacggcctttacagcaaggcgcttgccaaccgcgaggcgcgaacctggacggcaaaaacgttcgatgagcttaaagagctggccatggagaaaaccggcttcatcaagtcgatgtggtgcggcgacgaggcgtgcgaactgcgcgtcaaggaggaggcggggcttacctcccgctgtatgcctttcgagcaggagcatatcggcgacacctgcccgatctgcggcaagccggccgtcaccagcatcatctggggcaaagcctattaagcctccggcctttttgaaaaaaggcccccgcttttttgaaaaaaagctcggcaaaaaactttaatcggctgcgccgcgaacagtggggcaggcgctgcgtctatacaggctgcgccgcgaacagtggggcaggcgttgtctatcacgagccgcaccgaggtatgggaaacaagttgtaaacaagggggagcatttgtggagaacggatacaggaatacactattgaaggttacagctattttactgattgtatcggcgattctcggcgttgtgtcggcggtgatgctggccgtgggggtcggccgtgaaatcggcggtgtggacggcattggcggcatggtgatggagatagcgcttgacgatccgtcgtttttgtctgaagccggcatttccagcccggaggagctgcaatatgtgcttgaaacagacgacttccaggatattatgggcgcgacgctcggcattgtgtatgccatgatgattgtaatcgctgtcatcgcggcgattccgcgcctgattgcgggcattatggggttgtcgcgcgcgtcccggccggagaaaagcggctttttccttggctggggcattgcgcttctggtgctcggcgtcatcgggatgctgttcgcgggcgggcttttctcgctcaacggtatcatcagccttgccggcggcgtgatcctgccggttctttacctggtcggttcctcgcagcttaaaaaagagttctggcgcaggcatgcggccggagaggttggcggaccgaccttctgatgaaaccttccccgccggggcgttgccccggcgattttttatggctgcacgcacgctgtggcggaggagctgcctccattggcacaagtgatcaaaaaaagcgaaaaaaatttgtaaaagtgccgggaaaatacttgcaatccgacaaggaatatggtattatactaaggcacgactgcactagatatgcgaggatgcgggaggtggccgcccttgaggcggggaatttccgcggagtatgtccgattttaaaccgggcgactttaatactgataaagcggcgcacgcacgcgttttgcgggcaagctgtgcgccggggcggcggtatgaagtccggataaacttgcgggtttaccggattttttgtatgtccgtccgcggaacacccggaagggtgtgctggaatttacggtatatgaagcgtcgtctagtcaaacatttaaggaggcgatcttcagtggcagtcaaggaaaaaatcagaatcaggctcaaaggttacgatcatcagctcgtcgacgcgtcggcggaaaagattgttgaaacggcaaagcgcacaggcgcgcgcgtttccggtccgattccgctgccgaccgagaaggaaattgtcaccatcctgcgcgccgtccataaatacaaggacagccgcgagcagttcgagatgcgcacccataagcggctgatcgacattctgcgcccgtcgaacaagacggtcgaggctctgacggggcttgagcttcccgccggcgtcgagattgaaatcaagctctgatttaggcaaaccccgacgacggtttttcgccgtcaggtcaagtcggccaagcgccgaccaataaccttcaggaggtacagaaaggtatgcaaaagtgcatcgtaggcaagaaaatcggcatgacgcagctttttgacgaaagcggcaaaatgatccccgtgacggtcgttgaggccggcccgtgcgttgtcgtacagaagaagacaaccgaaaacgacggctatgaagccgtgcagctcggtttcggcgacatctccgaaaaggccgtcaacaagccgctcaagggtcatttcgccaaggcgggcgtcgcgctcaagcgcgtgctgcgtgaatttcggctcgacgactgctcggctctgagcgtcggcgacatcatcaaggccgatacgttcgccgtcggcgacgcggtcgacgttgcgggcgtttccaagggaaagggctacgccggcaccatcaagcggttcggcaaccaccgtctcaaggagacgcacggttccggtccggttgcgcgtcacgccggctccaacggcgcgtgctcgtcgccgtcgagggtctttaagggcaaggggcttccgggccacatgggcgctgagaacgtcacggttcagaacctctccatcgtaaagatcgatgcggaaaacaatctcatcgctatcagaggagcaatccccggcgccaagggcggcgtggtatttatcacggatagcgtcaaggcgtaagggaaggaggatacacacaatgccaaaggttcaagtttttgatatggccggcaaggccgtcagcgaaatcgagctttccgacgccgttttcggcattacgccgaaccctgtggctgtccacgcgtgcgtcgtgaactatctggccaaccagcgccagggcacgcagtccacactgacccgcaccgaggtcagcggcggcggccgcaagccctggaggcagaagggcaccggccatgcgcgccagggttccatccgcgcgccgcagtggcgcaagggcggcatcgcgctcggcccgaagccgcgcagctaccgctatacgctcaacaagaagcttaaaaggcttgcgatcaaatcggtcttttccgataaggtcgccggcagcaacctgattgttgtcgattccatcgcgctcgagggctttaagacgaaagccgttgtcgagatgctcaaggcgctcggcgccgataaaaaggcgctcatcctgatgcctgagcttgaccagaagcttgtcaagagcgccgccaacatcccgggcgtcaagacggcgctggtcaacaccatcaacgtctacgacctggtcaactgcgacaagttcattgtctgcaaggacgcggtcgccaaactcgaggaggtgtacgcgtaatgaaagctccgcaggatattatcctcaacccggtcatcacggaagcgtcgatgggcaatgtgcagcagaagaagtacaccttccgcgttgccaaggacgccaacaagatcgagattacaaaggctgttgaaagcctgttccccggcacgaaggttgcgaaggtcaacacagtgagctgccgcgggcgcatgaaacgcatgggccgcacgatgggcatgaccgcctcgtggaaaaaggcgattgtgacgctgaccgaggcgtccaagacgatcgaattcttcgacaccatgctgtaaagaacctggattgcgagtacaggttccaagggccgccagggtccgcgtatggggtatctcatatgccccgctaaccagaattatgaggagtgaaaccgaatggctatcaaaagctataagccgacaacgccgtcgcgccgccagatgacggtgaccgattacagcgaattgtcgaaggttgcaccggaaaagagcctgctcgagccgctcaaaaagcattccggacgcaactccaacggccgcatcaccgtgcgccaccgcggcggcggcaaccgccgcaaataccgcgtgatcgattttaagcgcgacaagaccgagatgcccgccaaggtgctcacgctggagtacgaccccaaccgcagcgcgcacatcgcgctggtgcagtatgaggacggcgaaaaacgctatatcatcgcgcccaacggccttaaggtcggcgacaccgtcgttgccgggccgggggcggacatcaagccgggcaactccctgccgatggccagcatccccacgggtacgttcatccacaacattgagctttatcccggcaaaggcgcgcagctcgcgcgttccgctggtgtcatggcgcagctcatggccaaggagaacggctacgcgctcgtgcgcctgccctccggcgagctgcgcaacatcccggagatctgcgtggccacgatcggccaggtcggcaacatcgactatgaaaacgtcaactacggcaaagccggccgccgccgccacatgggctggcgcccgaccgtccgcggttccgtcatgaacccgtgcgaccatccgcacggcggcggcgagggcaaaagcccgatcggccgtcccggccctgtcaccccgtggggcaagccggcgcttggttacaagacgcgcgcgacccacaaccgttccgacaagtttattgtcagacgccgcaacgcgaagtaagacgggctgaaaggaggcaatcgatttatgggtagaagtgttaaaaagggaccgttcgttcagcccgttctgctggccagggtccaaaagatgaacgagagcggcgagaaaaagcaggttctcaagacctggagccgcgcttcaacgatattccccgattttgtcggacacaccttcgcggttcacgacggccgcaagcatgtgccggtttatgtgaccgaggatatggtcggccacaagctcggcgagttcgcccccaccaggacgtaccgcggccatgccggcgcgaagaaaacaaaataagagcggccgaaaggaggaacacattcaatggaagcaaaagcttcgctgagacatgcgcgcatctcgccccgcaaggtgcagatcgtgcttgatctgatcaggaataaacccgccgatcaggcgatggcgatactccgccacacccccaaggccgcctgcgagccgctgtccaagctgctcaaatcggctatggccaacgcggagaacaactttaacatggacagggattccctgtatgtttcggagtgctacgtgaccccgggcccgacgatgaagcgcatccgtccccgcgcccagggccgcgccttcagggtgctcaagaggacttcacacgtgttcatcaccgtcaaggaacgggaataaagctgaaagaggaggtaaactatgggccaaaaagtgaatccgcacggccttcgtgtcggtgtaattaaggattgggattcccgctggtttgctaaggacgatgctttcggcgacatccttgtcgaggattacaagctgcgcaagttcttaaagaaaaccctgtatgacgcaggtatcccgaaaattgaaatcgagagggatgcgacccgtgtgcgcatccatgtgcattgctcgcgcccgggtatcgtgatcggcaagggcggcgcggagatcgaaaaggtccgccgccagtgcgacgcgatgatcaacaagggcaaggccgacgccgacaagcgtcaggttttcatcaatgtcgttgagatcaagcagcccgacaaaaacgcgcagctcgtcgccgagtcgatcgcttcgcagcttgaagcgcgcgtttcgttccgccgtgcgatgaagcaggccatcggccgcgcgatgaagttcggcgccaagggcatcaaggttgcggtttccggacgcctgggcggcgccgaaatcgccagaagcgaacattaccacgagggcaccatcccgctgcagaccatccgcgcggacatcgactacggcttcgccgaggcgaacacgacttacggaaggatcggcgtcaaggtctggatttacgccggcgaggtgctcggggatgccaagcgtccccgcagggaaggaggcaacaagtaatgctgctgccgaaaagggttaaataccgcagggtacagcgcggccgcctcaagggcaaggccatgcgcggcaacaaggtcacttacggcgacttcggccttcaggcgctcgagccggcctgggtcacctccaaccagatcgaggcagcccgtatcgccatgacgcgttacatcaagcgcggcggccaggtctggatcaagattttcccggataagccgatcactgaaaagccggccgagacccgcatgggttccggtaagggcagcccggagtattgggtcgccgtcgtcaagcccggccgcgtgatgttcgaaatcggcggcgtgagcgaggagctggcccgcgaggccatgcgtctggccgcgcacaagctgccggtaaaatgcaaatttattgccaaggaatctgaggaaaaggggagtgacgagtgatgaaggcaagcgagatcagagagcttagcgacaaggaactgggcgagaagctgcgcgacctcaaagccgagcttttcaacctccgtttccagcacgcgatcaatcagctcgacaaccccaagcgtttaagcgacgtcaaaaaggacatcgcgcgggtcaagacccagatccgggccaacgagctgaaaagcgcgcagtaagcggaagggaggacaaagcagatgagtgaacgcaatctcagaaagacacgcgtcggcacggttgtcagcgacaagatggacaaaacagtcgtcgtcgccatccaggacaacgtccggcaccccctttacaaaaagattatcaagcgtaccgtgaagtttaaagcgcatgacgagcagaacgcctgcggcgtcggcgacaaggtcgagatcatggagacacgccccctgtccaaggacaaacggtggagagtgaccgcgatcatcacgaaggcgaaataatagattcagttttgctgaaaggaggaacgctctgtgatacagatgcagacctatctcaaagtagccgacaataccggcgccaaggagcttatgtgcatccgggtgctcggcggctcccgcaggagatacgccaatatcggcgatgtggtcgtggcttcggtcaaaaaggctgcgcccggcggtcaggtgaaaaaaggcgacgtggtcaaggcggtcatcgtccgctccgccaaaggcgtgcggcgtgacgacggcacatacatccgctttgacgagaacgcggcggttatcataagagaagacaaaaacccgaggggcacgcgtatctttggaccggttgccagggaactgcgcgaaaaggaatacctcaagattttaagcctcgcccccgaggtgctgtaatggaggtgctcagatagtgaagaagcttcacgtgaaaaagggcgatacagtcgttgtcctgtccggcaaggacaagggcaagcagggcaaggtgcttgaggtaagccccagggagggcaaggtcattgtggaacgcatcaacatggtgactaagcacgtcaagccccgcagggcaggcgacccgggcggcattgtgaaggccgagggcgccatgtacgcatgcaaggtgatgcttgtgtgccccaagtgcggcaagccgacgcgtatcgcgcataaggtgctcaacgacggctccaaggagcgcgtctgtaaaaatcccaaatgcggtgaaactttttaagtaaggaggagaaatcatggcaagactcaaagaacagtacgcgagcgaatttgctcccgcgctgatgaagaaattcggctatacctctgtcatgcagatccccaagcttgataaggttgtcatcaacgtcggctgcggcgaggcgcgcgataatcccaagatcatcgacgcgatcgtctccgatctttccaagatcacgggccagcgcccggttatctgcaaggcaaaaaagtccgtcgcgaacttcaagctgcgcgagggaatgaatatcggcgcaaaggtgacgctgcgcggcgagcgcatgtatgagttcgtcgaccgtctctttaacgtggccctgccgcgcgtgcgcgacttccgcggcatcaacccgaacggcttcgacggccgcggcaactacaacatgggccttcgcgagcagctcattttcccggagatcgattacgacaagatcgacaaggtccggggcatggacatctgctttgtcaccactgcaaaaaccgacgaggagtcccgcgagctgctcacgctcatgggcgctccgtttgccaagtaagggggaagtattttggctaaaacatccatgaaagtcaagcagcgccgcccggcgaagttttcttcccgcgagtatacgcgctgcaaaatctgcggaaggccacatgcttaccttcgcaaattcggcgtctgccgcatttgtttcagggaactggcgtacaaagggcagatcccgggcgtcaggaaggcaagctggtaagaacaaagctgagctaaaaggaggttgacggcatgcatatcaccgatacgatcgctgacatgctgacacgtatcagaaatgcaaacaatgcaaaacatgatacggtcgatattcctgcttccaacatgaagaaagcaatcgctcagattttgttggatgaaggatatataaagagtttccaggtcgtcgaagacggcaagcagggcaacatccgcgttgtcctcaaatacgggcagggcaagtccccggttatccagggccttcgcagggtttccaagcctggcctgcgcatttatacaagctgtgaggatatgccccgcgtgatgaagggactgggcgtcgccatcctgtccacgaacaagggcgtcatgaccgaccgccaggcccgcaaggaaaacgttggcggcgaagtcctcgcattcatctggtaagggggtacggaagatgagcagaatcggcagaaaacccatcgccgtgcccgcgggcgtcgacgtcaagatcgacggcagcacggttacggtcaaaggacccaaaggcacgctgacgcagaccttccgtccggagatcggcatcaaatttgaaaacagcgagatccttgtcacgcgtcccaacgacgagaaaacggaaaagagcctgcatgggcttacccggacgctcattgcgaacatggttcacggcgtgaccgaggaattcaaaaaagagcttgagatcaacggcgtcggctaccgcgccgccaagcagggcaagcagcttgtcatgacgctgggcttctcccatcaggtgtttatggaggataccgcagacgtcaccatcgacgtgcccgctcccaacaagatcatcgtccacggccccgacaagcagaaggtcggccagttcgccgcggaaatccgcgagaagcgtccgcccgagccgtataagggcaagggcatcaagtatgtcgacgaagtgatcatccgcaaggaaggcaaagcgggtaagggcaagaagtaaaggagtgaaatcagaatggtaacgaagcctgacaagaacatcgccagactcaaacggcataagagggtcagggcaaagatcagcggcacgcccgagtgcccgcgcctggatgttttccgctccgccaaacacatctacgcccagatcatcgacgatgtcaacggcgtcacgctgtgctcggcctccacgatggataaggatttcgagggcaacggcggcaacaaggaagcggcaaagaaggtcggcgccgcgattgcaaagcgcgcggccgacaaagggatcgccgaggttgtgtttgaccgcggcggatatatttaccatgggcgcgttaaggagcttgctgaggcggcccgtgaaggcggactcaaattctgaagaaggagggatacttttggctttgatagatgcagcgaatctcgaactgaaggaaagagttgtttcgatcaaccgcgtttccaaaacggtgaagggcggtcgtatctttaagttcgcagccctcgtggttgtcggcgacggcaacggcacggtcggctttgggcttggcaaggcgggcgaggttcccgacgcaatccgcaagggaattgaggacgccaaaaagaacctgcacaagattgcgctcaagggcacgacgatcccgcatgagatcatcggcgcttacggcgccggacgcgtgctgatgaagcccgccccggaaggtactggcgtgatcgccggcggtccggtccgcgccgtgcttgagacggccggcatcaaggacatccgtacaaagtgcctgcgctccaacaacccctgcaatgtcgtttccgcgacgatccagggactgtgcgcgctgcgcgacgccgaaaaggtcgcggccattcgcggcaagtccgtgaaggatattattggttaaaggaggctggcgcaaatggcacagcttaaaattaagctcgtaaagagccttgtcggcagaaaagacgaccagatcgccaccgccgaatcccttgggctgcgcaagatcggcagcgagacaatccagcccgataacggcgcgaccaagggcaagattgcgaaaatttcccacctcgtcgaggttacgaacgcataaagcaaggaggtgcaggtatgaaattgcatgaactttccccggcgccgggcgccagcaaggacgtgttccgcaaggggcgcggccacggttccggcaatggtaagacggccggcaagggccacaagggccagaaggcgcgttccggcgccaagcagcccgggtttgaaggcggtcagatgccgcttcagcgccgcgtgccgaagcgtggctttaccaacatcttcgccacaaagtatacgaccgtgaatgtcggcgccctcgagcgttttgaggacggcgcggtggttgatgcacaggccctgatcgatgcgggcctcgttaagaaggtccttgacggcgtcaaggtgctcggcaacggcgagctgactaagaaactgacggtcaattgcgcggctttttccgcttccgccaaggagaagattgaaaaggcgggcggaaaggctgaggtgaagtaaacatgttcacgacgttaaagaacgcctggcatattgcggagctgcgcaaaaagatctgctacacgctgctgattctgattctgttcagggtcggttcggcggtgccggttccgttccttgactccacggcgctgcaggcgatggttaccggcagcggcaacctgcttggatacatcgatatcctttcaggcggcgcgttctcgcgcgcaaccgtgtttgccctgtcgatcaccccgtatatcacgtcgtccatcgtcatccagctgctcacagtggcgattcccgctctggaacgcctttcaaaggagggcgaggacggacgtaaaaagatcaacaagatcacgcgctatgtcaccgtcgcactcgcgctgctccaggcgtttgcctattacaccctgctgcgcaaccagagccgggcagtcctttaccgcagcggctttgccggaatcttttccgcgctggtgatcatcgcggcctttacggccggcgcgatgctcgtcgtctatctgggcgagcgtatcgatgaaaacggcgtgggcaatggtatctcactgatcctgttcgccggcatcgtctcgcgcgccccgaatgcgatcaatacgctctggtcgtatctgaagctcgcggccgagggtgaaacaatgtattatttcaccgtcccgctgatcgttgtgctgtttttggcgctgattgtcgttatcatcatcatgacaaacgccgagcgccgcatcccggtgcagtacgcaaagcgggtcgtcgggcgcaagatgtacggcggccagtcgacctttatcccgatcaaggtcaacatgtcgggcgttctgccgatcatcttcgcctcctctctgctggcaatccccggtacgattctcggctttatgtcggacaaaacgggtctggtgggcagaatcctcagcgccttcaattacgatacggcgctgtacgcggttctgtatttcatactgattctcgccttcaactacttctatgtggcgattcagtacaatccgattgagatgtcgaacaacctgcgcaacaacaacggcacgatcccgggcatccggccggggcgtccgacctccgactttattgcgcgcatcatttcaaagatcacgctggtcggcggcatcttcctcgcgcttatcgcggtccttccgatcggcgtcggcgcggtcacaaagatgaatattgcgctgggcggtacgtcgatcatcattgtcgtcggcgtcgcgctcgacacgttcaggcagctcgaatcgcaaatgatgatgcgtcattacaagggcttcttagagtaaaggagacgtcgatatgaaactgatactcctcggcgctcccggcgccggcaaaggcacccaggcggaaatcatctgcgagcgtctcggcatccccgcgatcagcacgggcaacattatccgcgaggcgctcaggaatgggacggaaatgggactgcgcgcaaaatcctatatggaaagcggcgcgctggtcccggacgatgtggtcatcggcatcatcaaggagcgccttgccgcggatgactgcaaaaacggattcatcctcgacggcttcccgcgcactgtgccgcaggccgaggcgctggatcagatgggcgttgagatcgaccgcgtgatcgatatcgaggtccctgacgccgcgattgaaaagcgtatgtccgggcgccgcgtctgcggaagctgcggcgcgagctatcatcttgactacaaggcccccaaggccgaaggcgtctgcgacaaatgcggcggagggctgatcatccgcaaggacgacgagcctgaaaccgtccgcgaccgcctgaaaacgtaccacgaacagaccgagccgctcaaggacttctacgcgtccaagggcaagctgcgcatcgtggagggccaggaggaagtcgctgatacgacgaagcttacgctcgccgctttggaggcgtgacgtatggtcgtgctgaaaacttcgggtgagctggccaagatgaaaaaagccggctcgctcgcggcgcaggccctcagggccggcggcgcggccgttcggccgggcgttacaaccggcgagatcgaccgcatcatcaagcattatattgtttccaggggcgccaccccctcgtttttggggtatggtggttttccgggcagcgcgtgcgtgtctgtcaacgatgtgattattcacggcataccgggcggacgcgtgatccaggaaggcgatatcgtcagcatcgatgtcggcgcgcttgtcgacggctatcacggcgatacggcagccacgttcgcggccggcgcggtcagcgcgcaggcgcaggctttgatggacgccacgcgtgaaagcctgcttgcggccatcgctgtcgcaaagccgggcgcgcgcatcggcgacatcggccacgccgtgcagtcgtatgtggaagcgcgcggatacggcgtggtgcgcgaatatgtcgggcacggcgttgggcgcaagctgcacgaggagcctgaggttcccaactatggaaagccgggccacggcgtgcgtctgacgcctggcatggtcatcgccatcgagccgatgatcactgagcattcgccggctttacacgtgctggacgacgactggacggttgtgacgaacgatcacggcctggctgcgcactttgaacacacaatcgcgatcaccgcggacggcccggtgatcctgacgcttccctgatgggggcgggcgggatgccggtcgggacgggacgcgtcgtgcgttccattgcgggacgcgacgcaggcgtgttttatgtggtccttgaagaccgggacggacgtgtgctgctcgcggacggcaaacgccggccgcttgagcggcccaagtgcaaaagccgcaggcatatccggaaaaccaacacggtgctggagctgtccggcgccgccaccaacaaaatgctgagaagggcgcttcggcccttctatgaaaacgagggaggagaaccgcttgtctaaagaagatgtcatcgagattgaaggcaccgtcgtggaaagcctgccgaacgcgcagttccgtgtcgagctgccgaatggacatcagctgctggcgcatatttccggcaaactgcgtatgaactttatccgtatcctgccgggagacaaggtcacgctggagatgtccccttacgatctgacaaaggggcgcatcacctggcgttccaaataatcagacccctaccgttaccgaacgaaggaggtaatttcaaatgaaagtcagaccttccgtgaaacccatttgcgaaaaatgcaagattatcaagcgcaagggccgcatcatggtgatatgctcaaaccccaagcacaaacagcgtcagggctaagtgtgcaaaccaaataatggaggtgcaacagaagtatggctcgtatagctggcgttgacctgcccaaggataagcgggtcgaaatcgggctgacctatattttcggcattggccggaagaccgcgcagcagattcttgaagccaccggggtgaatcccgatacacgcgtcaaggatttgaccgaggacgacgtttccaagctgcgtgaatatatcgaccacaacgtccatgtggaaggcgatctccgccgtgaagtcgcgctgaacatcaagcgcctggtggaaatcggctgctatcgcggcgtgcgtcaccgcaaggggctgcctgtccgcggacagcgcaccaagacaaatgcgcgcacgcgcaagggtccgaaaaagaccatcgctaacaagaagaaataagggagggatataaacgatggcgaaagctaccgctactaaaagaacggcgacccgcaggcgccgtgaacgtaaaaacattgagcgtggcgccgcgcatatccagtccaccttcaacaatacgattgtcaccattaccgatacccagggcaacgccctttcgtgggcttcggccggtgggcttggcttccgcggttcgcgcaagagcactccgttcgccgcgcagacagccgccgaggttgctgcaaaggccgccatggagcatggccttaagacggtcgaggtgttcgtgaaaggtcccggttcgggccgtgaagccgccatccgcgcgctccaggccgcgggtcttgaggtcaacatgatcaaggacgtcacgccgatcccgcacaacggctgccgcccgcccaagagaaggcgcgtttaacgaatcagggcgacgcgcaaaggcgcggagcctcaaaccattttggaggtgcaattcatggcaagatataccggtgctgtatgcaggctttgccgcagggagaacaagaagctgttcctcaagggcgaacgctgctacaccgataaatgcgccgtcacccgcagggcgaccgtccccgggcagcacggcaaggcgcgcacccgcaaggcttccgagtatggggtccagctgcgcgcgaaacagcaggccaggcgttactatggcatcctcgagagccagttctccaagtatttcgagatggctgcgtccaagagcggcgtcaccggcgaaaacctgctgcgtatctgcgagagcaggcttgacaacgtggtctaccgtctgggcttcgccgcatcccgcaaggaagcgcgccagctcgtccgtcatggccatttcactgtgaacggcaaaaaagcaaatatcccctcgatcctgctcaaggctggcgatatcgtcgcggttgcttccaagagcgacaagatcaagggcgtcgttgaggcgttcggctccaggccggtcgcaagatggctcgaatgcaacaagaccaatatgaccggccgtgtcatcgagcttccaaaccgtgaggacatcgaccttgacgtcgaggaacatctgattgtcgagttgtacagcaagtaattgctttgcggcgcatatgcgccgcggacgtgttcgtcatggttgcagggaaacgggaatgacagggcggggctttcccgccgcaaaaggagggtccatatttggttaagatcatagaacccaagatagaaacggtcgagctaaaatcggacggcagttacggcaaatttgtagcggaaccgctggacagaggattcggtaccacgcttggcaacagtctgcgccgtgtgctgctttcttctcttcctggcgttgcagtcatttctgtcaagattgacggtattcagcacgaattctcgacaatcccgggcgtcaaggaggatgtgacggaaatcatcctcaacatcaaggggctgaccgcaaagctgtattgcgatgagcctaagactgtgcggatcgacgcgcagggcgaatgcgaggttacggccggcagcatcgagtgcgattcggaggttgagatcctcgacccgagtatgcacatcgccacgctggatacgggcgcaaagcttgcgatggagatcacgctcaaaaaagggcagggctatgtttcggccgaccgcaacaagcataccgagcttgagaaagcgccggtcggcaccattgcggttgacagtatctatacgcctgtcctcaaggtgaattacacggttgaaaatacgcgcgttgaacagataaccgactatgataagcttacgctggaagtctggacggacggcacgatctccgcaaaggaggcggtcagtctggcggccaagatcctcaatagacaactcaatcatttcgtcgatctctccgacgaggtgagtgccactgagatcatggacaaaaaggaagacacgggcaaggataagctccttgagatgaccattgaagagcttgacttatccgtccgcgcgttcaactgcctgaaacgggccggcgtcaacaccgtggcggatctcatcaacaagtctccggacgagatgatgaaggtacgcaatctcggtaaaaagtcgctggaggaagtcatctggaaattgcagtctctgggatttgacctttcaaaggacgacgataactaaatctatgggccgcagcggcccgtggtcccggcggcgtgccgccagggttacaatgcaagggtaaggagtgaaattcgatgccaggaaccagaaagctcggcagaacgtccagccacaggatggcgatgctcagggcaatggtgacgttcctgctggaaaacggccggatcgaaaccactgtcacgcgggccaaggaagtgcgctcgatgaccgagaagatgattacaacggcgaaaacaaacgacctccactccaagcgtcaggtactctcttttgttacgaaagaggacgttgcgaagaagctctttgacgagatcgccccgaagtatgccgataccaagggcggctatacgcggatcgtcaagatcggacctcgccgcggcgacgcagcggaaatggcgatcatcgagcttgtctgagcttgatgttcaagggataaacgaaagggcgcatccgttacggatgcgccctttcccttacgggaagtgatggatatgtatgcaaatattaagcggcgtatgcatggcagaatgatctttctcacgatactgttttttctgctggcggggatattgttgacaaacggttttaacatgctttttaccgaaggcccttcctatacatatctggagcagacagagaagatctttgaggagcgcgggcaggttttgcctgaggaggagcgcgcgcgtctcatggaaatggacgccagtatgaacgcgcagatgcgcagggaacgccggatgtgggcgccggtactgatgctgtttggactggcggccggcgcggccggtctgctgacgctcgtgcgggggatgaatgtgccgggcagcaagcttgggaggcttgtcgcgctgtatatggcggagtgcggcgagacggatctgcatcaggcgcttatggagcttgagcgtgagttagccgtgccgctttatgattcgcgccatatgacgctgacagaaaactggctgatcggccataccggcatcacgcggcaggccatcgcgataccatacagttgtatcacaggcgtctattattatcatttactgcgtgtccggcccgggcgcggcacagtgcgacagttccatatcatgctcaacgaccgctttgaccgtgaacgccagctctggatggcaagcctgaaacagcttgacgagttgtatccgcttgtgtgtcaacgctgcccgcacgcggcgcacggcacatataaagaggattacgcgcgttatagcagccggccgcagcaggagcgggaggagcaaatcaggcggattctcgcggagaaccgcgccgatgggatgccgtatgtgaattgaccggcgcagcctgtatgaatgctgaagcccgtcccactgttcgcggcgcagcctgtatgaatgctgaagcccgtcccactgttcgcggcgcagcctgtatgaatgctgaagcccatcctactgttcgcggcgcagccgactaaagtttttcgccgaggccttttttcaaaaaggccggagcgcagccggcgaaagttttttggcttacctttttttcaaaaaaggtaagtttcaaaaaagcgggggatggaaagattgtaaagaagggcgttttgtgatatcatcatagcatcaatgcgattagggagatgcaggatgactaccacattgtatctggtgcgccatgccgaagccgaaggcaattggaagcgtacctttcaggggcatattgacagcgaagtgagcgaaaagggctggacgcagctcgattatctggcgcgccgctttgaacaggtccgcctggacgcggtgtattcaagcccgcttaaacgcgcctgggcgaccgccgaggcgatcaaccgttttgcggggctgccgattacgccggaacgcggcctgatggagatcgacggcggcgcgtttgagggcgtgccgttcgcagagctgcccgcgcgctacccggaggaaaacgcccggtgggacaatacgccgtggctgtttaaagcgccgggcggggagagtatgcggcatgtatttgaacgtatgcagatgaccgtcgacgccattgtgcgcgccaatccgggacgggtgatcgccgcagcctcgcatggctgcgccatccgcaactatctgtgctatgcgctcggctggccgctggagcgtatcgcggacgtctgctggtgcgacaatactgctgtcagcctgattgaatttgacgacggcttccggccgcatccggtttatctgaacgacgcgtcgcatctgccggaacacgcgtcaacgtttgccacacagtcctggtggcggcagggagcggagcacgccgcgcccgccgtaaaataaagcgggagactgcccgttatgaaagtgatttttgaagtctcaataagccgctgattaaggataggagctttcaatatgaaaatacttgctgttgatttcggagacgcgcgcacgggacttgcgtgctgcgaccggacagaatatctcgcttcgcccatcggcgtgctgcacgataaggattttggaagcgtcctgcaaaaagtggccgcggccgccagcgaatacgacgtacaggagatcattgtgggccatccaatcaatatgaacggcaccgaagggccgcgcgcacagctctgcgccgattttgccgggcagcttgcaaagcttgtgaccgtgccggtgcgcctttgggacgaacgcgggaccacagtgtcagcgacaggctttttgaatgcgacgaacacgcgcggcaaaaagcgcaaagaggttattgacgaggtcgccgccacgatcattttggaaagctatctcaattatcgcaggaaccatccacagaagttatgagcgcaatgcgctgtcaggctttttttgtatatattgtggaatttttcacacagatatagtatcataaccgcaaagcggttatgataccgcagccaaaaccggctttgccggtttacctgccgctttgcggcagacaagccgagaggctgtctttataaggcggcctgcgttgcagcatgttatgtacgattgtgaagtcaacatagaaggagtctgaatcatggattattccgcacttgccgatttgctgttccccggcatcgacacgacgcccgccgatattgaggcgcgctatccggcgcgcgtgctgcccgagggcgcaaatgtgacgcgcatggcgcccagcccgaccggctttatgcatctgggcaacctgttcggtgcgatcgcggacgagcgtctcgcccaccagagcggcggcgtattctatctgcgcatcgaggacaccgaccaaaagcgcgaggtgcccggcgcggttgagacgattttgcaggtcttttccgactatgagctgccgtttgacgagggagcaaccgtcgatggggacaacggcctttacgggccgtaccgacagcggcagcgcgcacagatctatcagacgtatgccaaatggcttgtccggcagggtaaggcatatccatgcttctgcacggaggacgagcttgcggcgatccgcgagaagcaggcggaacgtaaggaaaatttcggctactacggcaaatgggccgtctaccgcgatatgccgtttgatgaggtccgcgggaagctcgaggcaggcgagccgtttgtgttgcgttttcgcagcgagggcgatcccgcacggcgcgtcaaattcacggatcttgtgaaggggacgatggagctgccggaaaacgaccaggatgtcgtgctgctcaagtcggacggcatcccgacgtatcatttcgcgcatgtcgtcgacgaccatctcatgggcacgacgcatgtggtgcgcggcgaggaatggctcgccacgctgcccatccatattcagctttttgcagcgatgggatggcggatgccgaaatatgtccatacggcgcagcttatgaagctggacaacggcaataaacgcaagctctccaaacgcaaggacccggagctggcgctcgatttctaccagcggcaggggtactgtgtggcggcggtcaaggaatacctgttgacgctcctcaactccaatttcgaggattggcggttggccaatcccgaagcgccgctcgatcagtttgcgtttaacacaaagaagatgggcgtttccggcgcgctgttcgatatggaaaagctcgacgacgtctccaaaaatgtcatctcccgcatgacggccgacgaggtctacacgcatctgaccgattgggcgcgccggtatgatcccgatttctgcgcgctgcttgagcgcgatcccgcatattcgaaggcgatcctttccatcggccgcggcggcaaaaagccgcgcaaggatatcacggtctggagcggcgcaaaggaatatttatcgtttttctttgacgagctgttcaaacccgatctgacatatccggagcatgtgacggcggctgacgcaaaaaagctgctgaccgattaccagacgatgtacgacccggccgacgacggcgggacgtggtttgagcgtgtcaagacactcgccgagtcggtcggctatgcgacgaatatgaaggaatacaaaaaggaccctgcggcctggccgggcaatgtggcggacgcgagcatggtgctgcgcgttgcggtcactgggcggcagaattcgcccgacctgtgcgaggtcatgaagctgctcggcccggcgcgttcgatcgaacgcctgcgcctggcggcggaaaaactgtgatggaaggggcgtgcgcatgatggaaattgcgccgaattttttaacggatattatcgatgaggatattgaaaacggtctgaaggagcggattcacacgcgcttcccgccggagccgaacggctatctgcatatcggcagcgcaaaggcgatcttcatcaattattttatcgcaaagaaatataacgggctgttcaacctgcgctacgacgacacgaatcccgtcaaggaggacacggagttcgtcgagtcgatcgaggaggatctgcgctggctcggcgcaaatccggacgcgatcttttacggctccgattactttgaccagtgctatgaatatgcggtcaagctcatccgcgacggcaaggcctatgtctgcgatttgacgcccgatgaaatgcgcgaataccgtggcacgctgacacagccgggccgcgaaagcccgtaccgcagccgcacgccggaggaaaacctcgatttgttcgagcgcatgaaaaacggggagttccctgatggcagccgcaccctgcgcgccaaaatcgatatggcgtcgcccaacctcaatctgcgcgacccggcgatctaccgcattgtgcgcgcgcaccatcaccggcagggcgacaagtggtgtatttacccactgtatgattttgcgcatcctatacaggatgcaattgaaggtattacccattcgatgtgctcgcttgagtttgaaaaccaccgcccgctgtatgagtgggtcgtcgacaacatcggctttgacccgaagccgaagcagcgtgaatttgcgcgtctgaatatcacaaacacggtgatgtcgaagcggtatctgcgcgagcttgtcgagacgaagcgcgtcgacggatgggacgacccgcgtatgccgacgctgtgcggtctgcgccgccgcggctacacgccgtcggcgattttctcgtttgtacagcgcgccggcatcgccaagacgaacagccttgtcgatgagcggttgctggaatactgtatccgcgaggagctgaatgcgaacgcgccgcgccgtatggccgtcaccgagcctgtcaggttgatcatcgacaactatccggagggcaaggttgagtattttgagatcgccaacaacccggtcgatccagaagccggcgcccgcaaggttgccttctcacgtgaattgtacatcgaaagaaccgactttgccgaggcgccgccgccgaaattccagcgcctcaagccggacggcgaggtgcgtttgatgggcgcgtacattgtgcggtgcgtgcaggttgtcaaaaacgaagccggggatatcgtcgagctgcattgtatggctgatctggagacgggcaacgggatgccagcggatggacgcaaggtgcgcggcaccatccattgggtgtcggcggcgcacgcggttgacgccgatgtgatgttgtatgacaatttgtttacgcttgaagatgtcaacgccgtgccggaggggacaaactacctcgattatctcaatccagattccctgcgcgcgctgaagggctgcaagctcgaggcaagcctggccggcgcgaagcccggcgaccggttccagtttgtgcgcatggggtatttctgtaaggacagccataatgcgcacacgtttaaccgcatcgtcacgctcaaggacagctttaagctctgacagcaaaggggcccttgcagccaaaagctgcaagggcccttttgcgtcatgttttaggctgttcgatggggactccttcctgggattttgcaacgttttgtatatattgttcatttatataccattcgttaaatgcatcgcgtccatagacgccgagggaataaagctgttccaaggcgagcaggccgcgcggcgtgacgaggcaggcgtactttttgcgccaggcctcgaattcattgagcgggtcaagcgtaaagttgtattccgtacccatcagcgttacgtcgagacgcagtgattccggacgctcaagctcgaacgcatgcaggccagggctgttttcatagcgggcgctttcgatatcgacgaagaaaaagagcacgagccaggcggaaagcagaagggtcgagaagaaagaggcgacgaacagacgggcatcttttgttaacattttgtataatcaccttatttttcaacatcttgttgcgtttcgcggttctcattgagcaggcgggccagcgatttacccacaagctgcgctgtatagacgctttcatccagtgtatttgcgttagaaccgaactccaaaagcagcgaaccggttgtcagatccatattgtatttgcggtagcagaagaagatcgggcgggtaagctgtggcgtatcctgttcgatcgcgtcctggagcgaggcggcaaaacgcaggttttcacgccactttggcacgttcatggtaccgtcgtcgctgccggtaataatcatgagctgcgccgcttttttgccgtccacttctatggtgggcttgacgatcagatcttcctcgcgctgaatcgcatcgcggtgtacatcaagcgcgaccttgattgtcggatatttttccagatacgatttgatcgtctcggcgctgcgttcatacgcgccgttatacgatggatagtcgtgctgcgtgcgatcatggatgacgccgataccggcatccttgagcgcctgttccagagcgtcgcccacaacgatcatattattagtgttgtcggttgaacgccaggtattccgcatgtcataattttcactgtcgtatggttcgtagctttctgtggcatgtgtatgaaaaatcaatacctgcggttcgggcgtatcctccagatggatattcatgccctgttccatgatcgattcaatttcgtcagccggcagctcggtatagtttcgaagcagtccctcgccataggcgatcaggttcgtacccgaacctgacatattttcctgaagaattgtgccgcggtattcttcgctgatttgatgggaattatcccgggccggcgacgggtcggttgttttggccggaccgtccatgctttcaggcgcggaggatgtgggcgcggactcctcggagggcgcctgggagtccgcgccttcgtcatcgtcaaacggctccacataggatgcaacctgattctcaccctcccggtaatagctctcgtcgatcttgtccgcgaatcgggactccaaaagagcgatggagccttcaggcatgtttaccattgcggaaagcagagccgctttttccgtaagctctccaacatccggagaaagcgaaaaagccgcgatcaacgatagcggcaggacgaaaatagcggtcagcaaaaatggggagcggcgcgccggtttgtgttttcggacatgcttattcatactcgccgccccctttttggatagaaccgtttacatgcattttattcaggctgcggcggttttatgacggcaaaaggaatttttacgaggtcagataaacgatgtcctcaagcgaaagctgcggctggagcgcggcgttgatggaaaaggaaagcgtttttgcaccgcggtcaatgaccgcgtcgatatcgcgcggagtgaccatcatggcgtccgcgcccggcgcggcggcgcggtcatccgcatcgtgcaggatatcgcgcgcgagcgtttcgccgtcgaccacagttggaatgccgatggagacgacgggcgcgccgagcgtcgccgcattcagttcgcgccgcgcgttgaacacacctgaaccgggggatatgccgctgtccgcgagctgaattgtccggcccagacggtcgagcgaacgtgaggcgagcgcatcgatcacgatgacggcggctggtgagagatcgcgtgcaacggaatggacaatctcgccggtttcgatcccagtctggccaagcacacccggcgcgatcaccgcgacaggccgcagcgcgccaagccccgtgcgcgctgcaagctcacgcggaatatggcgtgtggcgaggatttgccgcgcggcgcgtgggccaagcgcgtccggggtgatgcggtcgttgcccaatcccacgacaagtacaggcccgcttttgggaagcagggatttaagctccgccgcacaggcgtgggttgcgtcgtccgcaccattgctttcacagacgggcggcgtctcaattgtaatatagcggccgcgcggccggccgagccggcgcgcggcgtcgtccgtatcgatgacgatgcgtataatccgcgcgctgccgcgcgtctgctcctgcatggatacgccgtgcggcaggcgctgcttaaattcggcggctgcctcgacagccagatcagtccggtacaggcgcatgggcgtccctcctttggcggggcggtgcgccccgcgcatgttacaaatctgttaaacttcacggcgcggttgtaaaaacacgccggttggtgtatattataagagccgtttccttttcgcacggctgtggctgcgtgccgcaacgggaagctttccaggctgctttccacaataaaaaaggattgatgcaagcaatgatgaaacgaaaaataggacgcgttttcctcgccgcaggcataatcatattgttggttgccctgctgcttttattcaatacgaattcaccctgggccttgattacgctggccctttcgatcatcctgaatacaatcggcctttccgctctgatggttcgcagcgtccgggacggtgcggatgatgattgaatatcggcttggcagcttccgccatgacttttttgatgaaaagtcctggcggaacaattgccagggctgttttgcgtctgttatatactgattgatcgtgctaaaaactggagggattttgggcgatggattatctgcgccgcacttgggcggaaatcgatctcgaccgcattgtacataatcaccgaatcatccggcagcgcctcacgccgggttgccgcaccatggcggtcgtcaaggccgacgcttacggccatggggacggttatgtatcgcgcgcgctccagcaggacggtgcggattggttcgctgtttccaatatcaacgaagccgtttccctgcggcggcagggcgttgtgcgccccgttctgattttaggctatacgccgccggagatggcgggacttcttgtcgaacaatcgctgacgcagactgtctattccggagaatacgcccgggcgctgtcaaaggaatcggcggcgcgcaaactcacggttgattgccatataaagattgatacgggcatgagccgtatcggattttttgcgcagcagggccatgcggcacaggctgccaatgaaatcgcgcgggtctgcgcgctgcctgggctttcctgtacaggcgcgtttacgcatttttcgtgtgcagatgaatacagtgctgacagccgcgcctttactcaccgtcaatttgaagtgtttatggagacgctcggcctgttgaagcaggcgggcgtggagtttgaactgcgtcactgctgcaacagtgcggcgacgcttgcatacccggaatatcatcttgacatggtgcggccgggcgttgtgctctatggcctgtcgccgtcgccggaatgcgcgggtatggccgcgctgctgcccgcgatgtcgctttatacgacggttacgatggtgaaaacactggatcagcacgcagccgtcagctatgggcggcgctatgtgacgcccaagggggggcgacggatcgcctcgattgccatcggctatgccgacggttaccggcgcaactttacaaataagggccgcgttataatccggggtcaatatgcgccgataacaggtgcggtttgcatggatcaactgatggtggatgtcaatgcaattgacggcgttcaaagcggagatgttgtaacgctggtcggcgaaaacggcggcgcggcgattacgctggacgatttcgcggcgctcaatggtacgatcaattatgaggaatgctgtctgatcggccggcgcgttccgcgtgtttacatgcagggcggccgtgagattgcggctgttgattatgtcattgcggctgtcggtgaacaaactgtccggccgctgtagatgaaaaacagccggacgcgtcagcgtccggctgttttataatttcttacagggttccgaaaatccgtttctccaggtgattcctttcaagcgcccataccagaagcaggcccagcacacagcaggggacaatctgcccgataccgacagacagcgccgatgatacaaacacgccggtattccagccgcccggagaaacaagggcgatttcagcgccgatgacaaccgcattgacaagcacgggcggcagcgacgagaatacgggaagaccgtgaatacgcatattgcgcagcgcgtagctcatcaacgcagcgattaaagtggcgctggtgccaaatactacgtcgatcagccccatggacgaaccgagcgcattcgacagcgcgcagccaagtgtaacgccccagatagcggcggggctgaatacgggcaacagtgtgaatgcttctgatacgcgcatctgcaccgcgccgaaggagagcggcgcgagcgcgagactgacggcgcaataagccgcggcgagcacggccgccgcagccatgcgccttgttgtgaaggttttttgcatattcttttttcctcttttccggagccttgccgcgctgcggccgcccctagtttttgttttaggtcaggatgttgcgaactgaccgctgctttgcagcatgaaatattgtacctgatttcagcccaaaaagcaaggttccggcctttttgaaaaaaggcctcggcgaaaaactttagtcggctatgccgcgaacagtggggcaggcgctgcgtaattcgttttacgccgcgtcgatcaaaagttttcgcccgcctttttcaaaaggcggcgggtgaggggcgggccaaggccccttgtgggttttggcccgccccgagggcagcgccctaatctctgggccgcagccctcacaaaagcgcgacccgcaggccgcaagacacccgttcaggcgtaccgcctgccccaagcaaaatccgtgacagacgctatgcggctggcgcggattttgcaagcgccagctttcccgcttttttgaaaaaaagcttggcaaaaaactttagccggctgcgccgcgaacagcgggacaggcgctgcgtttgatacaggctgcgccgcgaacagcggggcgggcagtcggcggttatgtgaaaatgaaggataaaaaaggagacggcccatgagctgcgacgccctgtatgtgcatatcccgttttgtgaaagcaaatgtccctactgcgatttttattcggtgaaagcggacggcgatttgatggaccgctacataggcgcgctggaacacgctttgaaaacgcagccgtacaagatacaacggctggataccgtttatttcggtggagggacgccgtcggcgctcggcgggcggcgtctgacacgcctgatggacgcggtgtgccggacgttcacggtttcgccggacgcggagatcacggtggagtgcaacccgcattccgcgctggagccggcgctgcgggcgctgcgcggcgcgggagtcaaccgcttgtcctttggaatgcagagcgccgacgacaggcagcttcgcgcgcttggtcggcgccatacggccaggggctttgcatccgccgtcaaagcggcccgacagtgcggatttgaacatctttcgttcgatctgatgcttgccacccccggacagacgaatgccgacattgattcagctgtaaagctgtgcgcgcagcttggcgcggagcatgtgagcgcgtatcttttaaagatcgagcagggcacgccgtttgcggcgcgccatatcgaggcggaatgtccggatgaagatggtcaggccgacctttatctctatgctgttgaggcgctcgcccggcagggatatgagcagtatgagatcagcaactttgcgcgcgatgggcatgttgcgcgccacaacctcaaatactgggatgggaaagaatatctcggcgttgggccggcggcgcattccttcgttaatgggcggcggttcttttttccgcgcgatctggcggcgtttttgcaggcggacgagccgttttcattgtgcgtcgacgatggactgggcggcggcgcgcaggagtatatccttttgcgcctgcgtctgacagaaggcgtcgtatggaaaacgcttgcggcgcgctttcccggctatgatgcgcgggcgctgcatgaaaaagcccgccggattcccgacgggctgctggtatcggatatgcgcggcctgcgtttgacgccgcagggatttcttgtctccaacgcggtgatcgcacaactgcttttatagcgcctttaagtatccattagacggcgaagctgcttgccaaaatcagcggcgacgccgcgcacactgtcgataatttcattgattccggcttcgatttccccggcagcggaggccttgaaaaagtcgcgcgaatgcgttttgcggtaccgcttgaccacctggcggattttttccgtctcctcggcggtcaggggctgattcgggcgcttgagcatcaggagcacattggcgcaatcggccaacagctctgtatattcgtcgtccacctgttttttaaagcgggctgtcatttgcagctcgtcggctggatcggtgaaacgcagctcgacaatcgatgcttcaccgcccatctggcggattttttgggcgagcgcggtaaactgctgcatactctgtgcggtattcggcagcagggcgacgccttgcttaaaatattccgcaccgatttccttgagcttgcgccacacatagacgcgcgcttttgacggcttgatcggcacgttgtaactgattgccagccagacggttctttgcattgggcgcaccccctcgttatctctgccacagatctattttattttaccctttgagagcggtttcgtcaacacccgcgtgcaggccggcggaattttccttgcaaggcggcgcattgaatgataaaataaatgcatggcatttattttatctccatatggccagggcgatgcgcgggcacggcccgctgccgccctgatggccgattttatcatgccgcgccgcggacatgataaaataaatgcatgacatttattttatctccatatggccagggcgatgcgcgggcacggtccgctgccgccctgatggccgattttatcatgccgcgctgcaaaggcggtgcgcgcatatcgcatatcaagtaaaattttgaatgcgccggccgggcgctgtacattctttgtgaccagtatggccgcttttgagcgacagccggcagcgttggttccaatcccccattcgccgggggagcattttatttctttctatgccgcatatggcggcggaatgggggattttttatttatgtcagttaaaaacctgatgttgcctgagcattatttttccaagcttgatattatggagacggaaatcgcgattaagctggcaaaggacacctttgagcgggaattggcgcgcgccctgacgctgacgcgcgtgtccgcgccgctgtttgtccgtcctgagactgggctgaacgatgatctcaacggcgtcgaacgcccggtccagtttgatatccttgatcttggggccgatgtgcagatcgtccattcgctcgccaaatggaaacgaatggcgctcggccgctacggctttgcgccgcagacgggcctgtacaccgatatgaatgcgatccgccgcgatgaggagcttgataatctgcattcggtctatgtcgaccagtgggattgggaaaaggtaatcacacgcgagcagcgcaccatggagacggtcgaggacgccgtccggtcgatcatgggcgcgctgtgcaaaacgcagaatgttctggccgatgcgtttacggcgcttgagcggtttttgccggagcagatctcgtttgttacaagccagcagcttgaggatgaatacccggaactgatgccgaaggaacgtgaaaacgccgcggccaaaaaatacggcgcggtatttgtctcccagatcggcggtaagctgcgttccggcaagccgcacgacggacgcgcgcccgactatgacgactggtcgctcaacggcgatatcctgatctggtacccggtgcttgggcgtgcgcttgagatatcgtcaatgggtatccgcgtagacgccgcggcgctgaagcggcagctcgaaacagcgggatgtatgcagcgcgccgggctgccgtttcacaggatgctgctggaggaccgcctgccgctgacgatgggcggcggtatcgggcagagccgcatctgcatggcgctgctgcaaaaggcgcacatcggcgaggtgcaggcttccgtctggccggacgatatgcacgacgcctgcgctgcgtcggggattcatctgctgtaatcagaaggtatagacggcttttgcgccggggatgggatgtgtgaatggaggatgggtatggatctgatcgaattatatggaagccgcgtttttaacgacgcggcaatgcgcaaatacttggcgcccgctgtttatgaaagcctgcggcgcacgcagagggaaggattaccgcttgattttgacatcgcgcaggcggttgcggaaggaatggctaaatgggctgtcgagcagggcgcgacgcactacacccattggtttcagccgcttacaaatatcactgccggtaagcacgacgcgtttttggaaccattgggcgacggcgcggcgctcgttttttccggaaaggcgctgatccgaggagaaccggatgcgtccagctttccgtccggcggtctgcgcgccacatttgaagcgcgcggctataccgcctgggacccgacatctccggcttttgtgcgcgatgggacgctgtacataccgacggccttctgctcctacggcggcgaggcgctcgatcagaaaacgccgctgctgcgctccatggaggctgtcagcgcggccgcggtgcggttgctgcatgcgcttggggagcctggggttacatgcgttacgccgacagtcggttcggagcaggaatattttttgattgaccgcgcgctttacgagaagcgtctcgatttgaaaatctgcggccgcacgctgctgggcgccaggccgcccaagggacaggagcttgacgatcattactgcggccgcatccgcctgcgcgtctccgattatatgcacgcgcttgatcgggagctttggtcgcttggcgtgcccgccaagacaaagcacaatgaggccgcgcccgcgcagcacgagcttgcgccgatgtacgatcaggccaatatcgcctgtgaccacaatcagctcacaatggagctgatgcgcatcatcgccaagcaaaaggggctggcgtgcctgctgcatgaaaagcctttttcgggaatcaatgggtcgggcaagcacaacaattactcgctgattacaaacgacggacaaaatctgctgtcgcagtccgatgatccggcgcgcaaccggcgctttttgctgatcctggccgctttcattgaggcggtcgacgagtatgccgatctgctgcgcgcttcggccgcgtgcgccggcaacgatcagcggctcggcggctgtgaagcgccgccggcgattatctcggtattcctcggcgagagtttgacgcgcgcgctgttttccatggcgcagggcgtcagcgccgccggcgaggagcggcggcacatccacaccggtgtcagcgcgctgcctgatctggagcaggatgattccgaccgcaacaggacttcgccgtttgccttcacggggaataaatttgagtttcgtatgctcggttcgtcccagtcgatcgcattgacaaacgtcgtgctcaacacggcgctcgctgaggtgttcggccggttcgcaggccgtctggaggcggcggagaataacgaggcggctatggctgccattgtcgcggatgttctgcgcgatcatggccgcgtgatcttcaatggggacaattattcggacgcatgggttcaggaggcgaaaaagcgcggcctgccggtcatcaattcaacagtggaggcgttcgactgcctgattgcgccgaaaaacattgcgctctttgagcaccatcaggtgtttactgagacggaatgccggtcgcggcgtgagatcctgcttgaaaattacgtcaagacgacggcgatcgaggccgcaaccatgattgaaatggtgcgccgccagatttacccggctgtcgcgcgctatgccggcgagatcgcaggcgttgtcaatgcgatgcgcacggccggcgcgccgtccgcttcggcaattcgcctgctcgatgcgctcgccgcgctgacagaccagattgacagcgagcttgacgcgctgcgcgacgcctatgcgcgcagccaatcgattgaacagccgcgcgcgcatgccgaatttatgcgcacgacgctgcgcggctgtatggagagcctgcgcgccgcctgcgacgccgcggaaaccgtgatggacggcgaacgctggccgatcccgacgtatacagatttgctgctgcgcgtctgaccagatgaatgaaggaggaggatgggcttggcggcttacgatgcgcaggaaaaggacgggcagcacagcggacaggcgcctgcgccgcaggaaaccgacaggcccgtgccggctcaggacgttccgactgatcaggtgtgtcctcaaccgtccgctgatgagctgtgtatgctcgcgctgtttttcgacctgttccagatgaaattaatgttccaattgctggctgaaaacggtattgccgccgaacagcgcggcggcgcggccatcggctattcgttgtttgtaaggccggaacagtctgcgcgcgcgagagagctgctggacacctttcttgcggacgcaccggctgcgcaggaaaaagcgcaggattcagttccggctgtttccggcaaggcagacgggcaaggttcagaggagcatttgggcgttgattctgacgccgaaggctttgatatcgacgatctggacgacgacgatatcggcgaaacgctcacgctgcacggcttttttaaggaccgcgcgtttaaacatgcgtcgctagtcctgtttgtggggctgccggtcggcgcgctgctgctgatgctgtttttgcagtggcttgcttccttcttttgaatatcaggataaaaaagcccgccccgcgccgccttttaaggtgggcgcggggcgggctttttctgccgggacggtttgccgccagaggcgtggcatccgcaaacaggaagccccggtcggtcaggcagccgttttgctgtatacagcgcggccaagcgaagcttcaaaaaaagcaagggaggttgggcgttggcaaaatccacgccagccgcgcagcgtctgtcatgaattttgctgtgggcaggcggtgcgcctgaacaggctcttgcggcctgcgggccgcgcttttatgagggctgcggcccgagtttagggcgctgccctcgaaaaaaggcaagacccgcaaggggccttgccttttttctcacccgccgccttttttaaaaggcgggcgaaaacttttgattgcgatgcgccaaaccttctgttcgcggcgcagccgactaaagttttttgccaagctttttttcaaaaaagcgggggcgcagccgaactaagtttttcgccgaggccttttttcaaaaaggccggaaagcttttttcaaaaaagcgggggaaatattactcaaccgcgtagagcttggagagcttgagcaggtgctggtaacggtcggcagcggtcttggcagccttctcggacagctcctcggcgcgatccgggaaggagcgggccagcgagctgtaacggacctcgttggagatgaaggccttatagtccgcggacggcgccttggaatcgagctggaacggattcttgccctcaagctcgaggcgcggatcgtagcggaacatatgccagtagccggcctcgacagcgcgcttgatctcggtctgcgcaatgcccatgccgcccttgatgccgtggttgatgcacggcgcgtaagcgatgatgagcgacggaccgtgatagctttccgcctcggtgatcgccttgatgcactgattgtagtcagcgcccatcgcgacctgcgcaacatagacatagccgtagctcatcgccatagcggccaggtctttctgcttgatggtcttgccggccgcggcgaactgcgcgacagcaccggtcggggtcgccttggaggactgaccgcccgtattggagtaaacctcggtgttgaagcagaagatgttgatatcctcgccggaagcgatgacatggtcaaggccgccgtaaccgatatcgaacgcccatccgtcgccgccgaagacccagttggacttcttggccaagaactccttatctttgagaatcgccttagccgcgtcacagccgcaggcttcgagcgcctctatcagcttgatcgtcgccagcttgttggcgctgccgtcgtcaaccgtggagaggtacgcctcgcaggcagccttcacatcagccttgtcagtgctcttggaaagctcgagaaccttggaaacgagctgctggcgcagggtgttctgagccaggaacataccatagccgtattcggcgttgtcttcaaacagggagttagcccaagccggaccatggccgtccttgttgacggtgtacggcgtcgacggcgcggaaccgccccagatggaggaacagccggtggcgttggcgatatacatccggtcgccgtagagctgtgtgatcagcttggcatacggggtttcgccgcagcccgcgcacgcgccggagaattcaagcagcggctgtttgaactggctgcccttgaccgttgtctccttgaacttctcgttcacttccggcttgaccggcagggactggccgtaagcgaagatttcctgctgtgcaagctgcgtgtcgagcttcttcatctcgagcgccttgttgccgcgcttgcccgggcagacattcgcacacgagccgcagccggtgcagtcgagcacggaaatcgtcatgccgaacttgtagccgggcataccggtcatatcgaccatcttcataccctcgggggccttttcggcttcctcggcggtcatgacggccgggcggatgacagcgtgtgggcagacatacgagcagaagttgcactggatgcagttgtccggaatccagcatggcgtgtcgacggcgatgccgcgcttctcataagcggcggaaccctgcgggaacgtgccgtcctcggcgccgacgaacgtggaaacaggaagcttttcgccgcgctgtgcgttggccgggatgaggatgttgttgacaaaatcaacgagatccttgcgctcgccgacagccttcgcgtcggtcgcgtcatcggcggcgtttgcccaggaagccgggacgtcgaccttgacgacagcctttgcgccctcgtcgatggcatcgtggttcatcttgacgaccttgtcgcccttggcgccgtaggatttggtcgcggcgtccttcatatatttgattgcgtcggcttcgtcaatgatcttggccagcttgaagaacgcggactgaagcacggtgttgatgcgggtgcccaggccgagcttgcggccgatgtcgatgccgtcgattgtgtagaactggatgttatgctgtgcgatgaagcgtttgaccttgccgggcaggcgctcctcaagctcctctgcgctccacgggcagttgagcaggaaggtgccgccgtcgacgagatcctcaaccatgtcgtacttggtgatatatgacgggttgtggcacgcgacgaaattcgccttgctgatcagataggtggagtggatcggggtatggccgaaacgcagatgcgaaacggtgacgccgcctgacttcttggagtcataagcgaaataggcctgcgcatacatatcggtatggtcgccgatgatcttgatggagtttttgttcgcgccgacggtgccgtcggagccgaggccccagaatttgcaggcggttgtgccgtccggagcggtgttcgggttctcatcaatcggcagggacaggaacgtgacatcgtcctcgatgccgatggtgaagcgttccttcgcgccggtttcgccgttcttgtacacggcgatgatctgcgccggcgtcgtgtcgcgggaaccaaggccatagcggccgccgtatacagggacgttggcaaactgcgtgcccttgagcgcggcgacaacatcgaggaacagcggctcgccgaaagcgccgggctccttggtgcggtcgagcacggaaatggatttgaccgtggacgggatcgcggcgatcagacggtcggccgcaaacggacggtacaggcggaccttgatcaggccgacctttttgccgtgcgcgttgagataatcgatcgtctcatcgatcgtctcgcagacggaacccatcgcaatgatgacgttgtcggcgtcgggcgcgccgtagtagttaaagagcttgtagtcagtgccaattttggcgttgaccttgtccatatattcttcaacgatgcccgggacggcgtcgtagaatttgttgcagctctcgcgcgcggtgaagaagatatcaggattctgggcggagccgcgcaggacaggatgctccggattgagggcgcggcggcggaacgcgtcgatcgcgtcgtggtcgaccatctcgttgaggtcctcgtaatcccagacctcgaccttctggatttcatgggaggtgcggaagccgtcgaagaagttgaggaacggcacgcggcccttgatggcggcgcagtgggcgacggccgtcaggtccatgacctcctggacgctgccttcgcagagcatggcaaaaccggtctggcggcaggcgtaaacgtcggagtggtcgccgaagatgttcagagcatgggaagcgacgcagcgcgcggaaacatcgatgacgcccggcagcagctcgccagccattttgtacatattcgggatcatgagcagcaagccctgggaagcggtaaacgtggtggtcagcgcgccggcggccagcgagccgtgaaccgtaccggccgcgccggcttcggactgcatttcgacaaccttgacttcattgccgaagatatttttgcggccctgcgaggaccactcgtccgtaacctcagccatcacagacgacggcgtgatcggatagatcgcggccagatcggtgaacgcatacgatacgtgcgccgcggcgttgtttccatccatggttttcatttttcttgccatgttttatcttcctcctacacaagattgaccatgccaaatatttagattttgggcggcggcgcggcaaagcgaagcgccaagcgcccatccttataaaggatatcatttttggcgcttcttgtaaataaaaaaaccccgaaaattatggattcggataaaaaatttgcctgaccatacacttgccggacaactattttttgtaaatttctgtggttaaattgacagcaggggaaaaaatgtttatcatatttttatcataccccaatatgtatgccaataaaatacaattgtccgcacaaaatccgtgcggatacaaaaggaatgaccgaatgatggacccctatcccagtatgatggcgctgctgccggcactgctctccgccctgctgtgcgccggacgcacggcgctgaccgtcctgaaggatcaaagcgttaagaaaatggcctcctcggaggaccgccgcgagcgatccgttgccaggctgctcgaaaagcccgccgcgctgctcgacggcgtcaagctggcatgccttttctgcaatgcagctgtcgtgctgcttgtgtacaacacgttttccggtatggctgtgcatctgttgcagcgcctgttttccggcgctgcgcccgcatgggcggtattgctgacgcatgtgcttgtatttgtgctggtggtctttctgcttgatgtgctgtgtacacagctcccataccgcgctgccagccgccgcccgcgcggcgcggcattcgcgctggtgggcctgtgccgtctggcggcatttgccatgcggccgtttgcagcggcgggcggcgccgcggctgaactgctttcaaggctgttcggcgcgcgcggcggcgatgaaacagagcgcgtcaccgaggaggagatccgcatgatggtcgatgtgggcaatgaaaagggcgcgatcgaacagagcgaaaaggatatgatcaacaatatctttgaattcgacgaccgcaatgtttccgaggttatgacacaccgcaccgatatgacagccgtccccaaggatgtgacgatcgacaggatcgttgcgatcgcgattgagacaggcttttcacgcatcccggtctatgacgaggatattgacgatatcatgggaattgtctatgtcaaggatcttttgtgtctgatcggtacgccgggcgtcgattttgacgcacagaaatatatgcgccctgcgctgtttgttcccgagagcatgagctgtgtcgacctgttcgcccagtttaaacagaaaaaggtgatggtcgccattgtcgtggatgaatacggcggcaccgcgggaatcgcttcaatggaggatctgctggaatcgatcgttggcaacattcaggatgaatacgacgatgaggacgaggagatctgcaagatgtccgacggcgtctacacacttgacggagctgtttccattgaggacgtcgagcgtctgtttgacattgagcttgatgaagattcggaatatgacacgatcggcgggctgctgatcgaaaagttggagcgcattccttcaccgcacgagcatcccgctttggagctttccggcgtgcgttttaccgtcctgcttgtcgaggaccgccgcatcgcccgcatccgcgccgaaaagccctcggctccagggcaggagacagcctgacgattttaccacagagcgcaccggcgtgcacccgatacgcccgcgccaaacagaggtggggataatataaggggagggtcgagcgaccctccccttgtgaggcgcgaaaaggggcgcagccgcggcttgtccgcgcccggcggctatagccgctggaaagccccgaatagccggccgggcaagcgcagcgcccggcggtgggcaatccgcacacggattgcgcgcgcctaagccggccggacaagcgcagcgtccggcggtgagtaatccggacacggattgcgcgcgccggaaagggagtatttatgcaggaaattatgggatatatccgccgcgctgtgacagagtacggtatgatcacggatggagatacggttgccgtcggggtgtccggcgggaaggattcagtcgcgctgctggccgggctggcaggcgtgcggcggtttatagggatttcatttacgctcaaggcgattacgctggacaaccagttcggcggcatcgagacggattacggcccgattgccgcgctgtgcgagcggcttggggtcgaatatattttaaaacgcacggacattggacgcatcatctttgacgagcgaaacgaatcaaatccgtgcagcctttgcgcgcgtatgcgccggggactgctgcatgacacagccaagacaaacggctgcaacaaaatcgcgcttggccatcactacaacgacgcggttgaaacttttttgatgaacctgtttaatgaagggcgcatcggttgtttttctccggtgacgtatctgtcgcgcaaggacctgacgatggttcggccgcttgtgttcgccacggaacgggaaatccgcaacgccgtcaaccgtgcgggcctgccggtagttaaaagcgcctgtccggtggatggctgtacagagcgccagtggacgaaggagtttctatacgatatggaaaaaaatcatccaggaataacaaaacgtatttttggcgcgatgcggcgcggccaggtttcggggtggtgacggtatgcagaattggcaaaaacgaacggcactgctgatcggcgaggatggcgtcggccggctggagcgggcgcgcgtggccatattggggcttggcggcgttgggtcggccgcggccgaggcgctctgccgcgccggcgtagggcatcttctgctgatcgaccatgacacagtggatgaaacaaacctgaaccgacagcttgtcgccacgcggccggtcattgggatgcccaagacgcaggccgctttgctgcggctgcgcgccatccgcccggacggcgatttcatgcccgccgagcagttttatctgcccgataacagcactttcctgtttgaatggcagcctgattatgtgatcgatgcgatcgataccgttacggccaagctgcacctggccggcgcgtgcgcggcccatggcgtgccgctgctcatgtgcctgggtaccggcaaccggctcgacccgtcggcgctgcgcgccggcgatatcgccgatacagccggctgcgggtgtggacttgcgcgtgtgatacgccgcgagctgcggcggcgcggtatcgggaggcaggcggttgttttttccacggaggagccttccaaatcggtctgccccagcgagcacggccgccacgcccccggaagcatcgcgtttgtaccgcccgccgcagggatgctgatggcttcccgcgcggtgcgcgatctgctcgcgttataacggcgggcgcatatgagacacctaataaataaaagcggtcagccgccccacatctgtgggacggctgaccgcttttttatagctattgatcgtttaaaaacacatcgacaatgtattttggccggtgcttgacctccttataaatcttgccgatatattcgccgaggatacccaggcacaaaagctggatgccgccgagcgcccagatggaacccataagcgtggtccagccggtcacggtatatccaaatagctttgtgatgagcagccagagcaggcacaaaccgctggccacaaagataataacgcccagagcggtgatcagtcggatcggtttgacagagaaggaggtgatgccgtcaatggcaaaggcgagcatctttttgagcggatatttcgattcgcccgcaaaccgttcatggcgctcgtaggcaacgaccgacgtgcgaaagccgatcagcggcacaatgccgcgcaaaaacaggttgacctcgtcgtattgggcgagcgcgtcgagcgcgcggcggctcatcaggcggtaatcggcgtggttttccacaatttccacgcccatccaacgcagaaaccggtagtatccgaccgccgtcgaccgcttgaaaaccgtgtccgttttgcgggacgaacgcacgccgtaaacgatgtcgctgcctgcctggtactccgcgacgaaccggtcgatcgcgtccacatcatcctgcaaatcggcgtcgagtgaaatggcgatgtcacaaaatcgctttgcctccatcaaccccgcgacaagcgcgttttgatgcccctggttgtgcgacagcttcagccccgaaaagcgcgggttttcgctatgcaggcgcgcgataatttcccaggtcgtgtcgcggctgccgtcgtcgacaaacagcacgcggctgtcctttgaaacgattcccaccgcgatcatgccgccgagcttttcatcgagccggcgcgccgtttcaggaaggacctcctgttcgttataacaggggatcactagataaagcgtctcgttcatttgggttcctccttgggtccgccgtccgatcctgtgggcggctgcggttcgtcaaaccattcggcgggcggcgtcagcggcccgtcgccgtccggttcgccgcgctgatcgttttcgagccattcggcgggtggttcctgctccttgccgtcgagacggtcaaagtcgctgtgtgcagaatatggttgatcggggcctttggcgccgccgtattttttgtaaagcagcagataaacaatcagaataagcagagcgccggcgctgacggccagaccgggatagagtcccggcgtcgtgtaggtgaaccggatggtgttgtcgccggcaggcgcgcgcaccgccatgaaaccgagatcaaccttttcgatttcagcggggacgccgttgacggtcgcggaccagccttcatcgtatgggacggaataaaagacaagattttcccgcggcagattgattttggaagtgaaaccgcggttgtcgatttcaaacgagtagccggctgtcgcgcggcggttttcacagtcggtgtagtattcgtcctcgcccagattgctgtagtaactctgcggcatccgctccagcaggtcgttgtggcgcgcggcggcttcatccttgagcacgagcgcccgcagcaggaccgccgcgcggtcgtcctccgggatctgttcaaggtcgcgcacagtaatatagtaatcaaaggtgaagcccatcggtataaaatactggttttcataaacattgtaaccaagctgtgtcgaatgcagctcatagccgggcatcacgtcctgatcctcgctgttctccgagataaagagccagcgcacagacagaagcggccgaagctggtaatactgtgtttccggcttggaggagacgtcgcgcttgacgccgaccttcggataaaattccattgtggaaacagggatgatgctgtgaaacgcctgaatattcggcaggtgccaatacatccccagattgtccatgcccttataaatatcggaacgcgcaaaggtatcgtccggcagttccaattggtaacggccgtcaagcgcggtatcacggataaaatcggtattgtcggaatgtgttttgcccatggcgatgaaggtgatcgagtagacgacgctgacaaaacagcaggcggccgtcatagcgcgcataaagagcttcggcgtgccgcgcaggcgcctaacgatcagccagagcgcgcccaacccgagcagggcgatcgccacagtggcggcgaaacggtcgggatattttgcaaggcagaacttgaccgaaccatctgactggagcgtcggcgtcaggccgaggatgattgttacgccggcggtaaagataaaggtccatcggatcccgcgctccagatcgatcgaccggctgcgcagcgcctgcacggtggccaacgccatcaaaaggatgggcatatagaaccagcgtgcataataggaggaattgaaaaggataaacatgctgttcagccccggcaccagagcggccacgaggcagaacaacaggatgcggcgcagccagtcgcgcttagactggacgtaggcgatcacgccgctcatgctgataaacggaagccaggcggagagcgacgcccattttgcgccgcgatccgggaacaggttgggccggcttggcagatcaggcgggaaaaacgcgctgctgacaatggccggatagagctgattatgccaataaagccagaagttccagccgttgagcgtttcgctcgcgccggtgcgcgggttgccgaggatcgccagcaccgacggcagaaaaagcgccatggccaaaagcaggccgacgaccgattcgaaggcggtccagaaaaaacgtttccaggtcatatgccagtcgggcgacgcggcgcggaaggcaaaatagatcagcacaaagacgacctcgccgatgaaaaaccagtagttgacgaacgcattgatggcgacagccagcgcaaacacgccgcgccggttgttgaccatcagctcctcaaggccgaccagaagaagcgggaagaagatgatcgcttcgtgaaagtgattgaaaaagatattgtaaacggcaaatccgctgaacgcatagagcagaccgccgaaaacagcataggaacgcggcgctacaaaccgcttgaaatagagcgtgccggtcgctgccgcacaggcgtgcttgagaatcaaaagcgggccgatcagatgcggaacaaattcagtcgggaaaggtagcgtcagccagaaaaacgggctgccgagcagataaaagctgtatgagccgatgaagttcgcgccgagatcggtataccagttccagaacagatcgccgctgcgcaccgcttcgtgcgcgagcttataaaaaggaatctgctggacattaaaatctccgtaaaaaaagaagtaccccttgtcccagatgatgaagggtatgaagataagcgcggccgttgccagggcgatcaaaaacgctctgcggcacgcgcctttgttttgttccggtgaaacaagcaacatcgatctctccttgtccgtaaagcgaattggtgtcgttttaaatcgggcggtaccagactgacggtcccgcatgagcggcgagccgttgggcataaatcggtataataaccgctctgcggttattataccaccaaattcctgttttaaaagatcgcgcggccggtacagggaaattttgccccggcgcgcttcttttcattcagtgcgcgatttgctataattgactgcataaaaagggggaacggatatgaaaacacacggctttttcgcgatgctgtcgcgtatgaaatacatcgcccggtggggcctgatgcgcaatgtgcgccaggaaaacttgagcgaacacacgctcgaggtcgcttatttcgcgcacgcgctggcgcttttgtccggcgtggacccggcgcgcccggtgttctgcgcgctttaccacgactgcgccgaaattttgaccggagatcttcccacacccgtcaaatacgacagcgccgccatccgcgacagctataagcaggtggaacgcgcggccgccgaacggcttttggccgcgctgcccgataagctggctgcggcgtaccggccgagctttttcgagcaggacgagctggttttgcgcattgtgaaggctgccgacaagctgtcggcgctcgtcaaatgcatcgaggaggagcgttccgggaaccgcgactttgaaagcgccaaacgcgcccagcttgaggcgctgcgcgcgctcaggctcccggcggccggcgaatttttaaagacgtttctgccggcgtatgaattgacgcttgatgaaatcgaattgtccggcgcgtcctcataaccggatgcgttcggcgcgcgcgtgtccgcatatatcgcgccgcgtgtaatcaaacagtagcgccgtttcgcccggcgcgcgcgccgggtccgtcacgtcgaaggggaacagctcgacatgcgtattcgtccccgaacgcacggcccgccgcgcggcgggcgccgtctcggggcagcatgccggcaggcggcgcgggcgctcgtgcaggcacaaatcgtattttaaaagccagcggcagaccgctgggtcgccgccccgggcgatacagaaatcatacagcaggtcgtaccgctcatatttgccgacgctgcgcgcgggcgccgcttcgcccagcgcaagcagcccgtaaaacggcgatggacacagggcgagcgtataggaaagcgtgtgggaaaagcggccgctgttatagtacgcttccgtcatctcctcgacaattttcagccgtgccagctccgcgaatgaaagctgcggcgtgcgcaggatttcatacggcggcgcttcgctgtgcacaaggccgtactgagcgcgtttggcgtacagcgcggagccgcgcagcagctttaaaaagccgagctgcaattgatgcgggcgcagcgcgaacacatcatcaaacgactgcgcaaagcgtgtgaagccctcaagcggcaggccggcgatcaaatcgaggtgcagggggatgttgcccgcgtcccgcagaacgcgaagattttcagtcaggcggattatatccgttttgcggcagatttcctccagcgtacgaacgcacgtgctctgcacgccgatttcgaactggaaaaggccggggcgcgccgtgcgcagcagttcgagctggcccggcgtcaaaaggtcgccgccaagctccatctggaaactggtgacgccgttgtcgtgttcgatgagaaagcgccagatcgcttcggcgcgcgccgcgtccagattgaaggtgcggtcgacaaatttgacctgcatggcgcgcgcgttaagaaaacgccgcaggtcgtcaaaaacgagcggcagcgcgcgcgtgcggacccttctgtctgcggatgagaggcaatagctgcatccatacgggcagccgcgcgtcgattcataataaagcacacggtttgaaagggcgtcgagatcgccgtagggaaacggcagggcgtcaaggtcggcaaaggaccgcgcggcaaagacgccgtgcggttttttcatgcgcacaatctcagcgatcaccggctcgccctcgccgctgataaccgcgtcggcccagggcgccgcgtcaagctgcgcctgcgcgtcgaacgacacctccggcccgccgagcacgatggccgcgttgggactaagcaggcggaaatccgcgccgatgcagcggatataatcgatgttccaaatataacaggagaacagcagcagatcaggagcacggcgcgcgatatccgcaaggatggcgcgcgccggttcgttgatggtatactctgcgatctctgacgcaatgcccgcctgtttaagcgcgttctgcagatagcgcacagccagattggtatggctgtagcgcgcgttcacggcggtcagaaggattttcacagcgacgccctcctgtcagcaaaccgcgtccttcggttttttcatcgtcagggagatgcgctttttcggcacgtcgaccgacagcacccagactgtgacgatatcgccgacgcgcagcacctcgctcggatggcggatatagcggtttgtgatctgcgagatatggacaagcccgtcctgatggacgccgatatcgacaaacacgccgaaatcgatgacgttgcgcacggtgccgcgcagctccatgccgggctttaaatcgccaaggtccatgatgtcgctgcgcagcatcggcggcggcagttcgtcgcgcagatcgcggccgggcttgcacaggtcggaaacgatgtcccgcagcgtcggcacgccgacgccgcaggcgtccgctacggcggtttcaccggcctgcttcacacgcgccgccaattcgtccaggtgattggccgtcacatcgccgagcgaatagccgaactgctcgagcagttttttggcggcgccgtatgattcggggtggacgcccgtttcgtcgagcacattctttgcgcgtgggatgcgcaggaaaccggcgcactgttcgaatgccttcgggccgagcttcggcaccttctttagctgcgcgcgcgatgtaaacgccccgttttcctcccggaaggcgacgacgtttttcgcaacggccggcgacagacctgccacatagccgagcaggggcgcggacgcggtgttcaggtcgacgccgacgctgttgacgcagtcctcaaccacgccggtcagcgtctcgtcaaggcgcttttgcggcatatcgtgctgatactggccgacgccaaccgatttcggatcgatcttgacaagctccgccagcggatcctgaagccgccgcgcgatcgacacggcgctgcgcagggacacgtcgtattcgggaaactcctcggccccgagcttcgacgccgaatagacggacgcgccggcctcgttgaccatcatataggaaaggccacagtcaagctcgcggatcagttcggccgcgaacagctcgctttccttggaggccgtcccgttgccgatggagagcacctggaccccgtgctttttgatgagcgcgccgagcatgcgctttgcttctgccaccttgttctgcggcggggtgggatagacgaccgccgtatcgagcaccttgccggtcgggtcgacgacggcgattttgcagccggttcggtaggccgggtcgatggccagcaccgtcttgcctttgacgggcggctgcatcagcagcgctttgaggttgacgccaaaatttttgatcgcctgttcgttggcagcgtcggtcagctctgcgcgcagctcgcgttcaagcgacgggtggatcaggcgcttatacgcgtcggcgacggccgccagcacggtttcggttgtaatgctcccctttttgacgaacaggcccgctaacaggccggtcgcatagtccgcgtccacatcgacggataccttgagtacgccctcgctctcaccgcggttgacggcgagcacgcggtggctcggcgcttttgcaaccggttccgcatattcgtaatacatggtataaacagactccttgtctgagtccacggctgtgctgcacaggcgcgcgttgcgccaataatagtcgcgcaggcgcgcgcggccctcggcgctgtcggaaatctgctcggcgatgatatcgcacgcgccggcgattgcgtccgccgccgtgggtacgtccttctcggcgctggcatacggcgcggcgagcgcctcgacgctgccggatgtctgatcctgagcaaggagcaattgtgcgagcggctccagcccgcgttcgcgcgcgaccgtcgcgcgcgtgcggcgcttctgcttatagggtcggtaaatatcctccagccgcgcaagcgtttcagccgcggcgatatcggcggcgagcgattcggtcagcttgccctgctcgccgatggcggataagacctcctcgcgccgcttttgcaggccacgcagatacgccagccggtcggcgagcgcgcgcagggtttggtcgtcgcacgagccggtgcgctccttgcggtagcgggcgatgaaggggatggtattgccctcgtcgatcagggcgatgatattttccaccagcggcggcgcgatgccgaattccttggaaagaagtgcggtacaatccatgctgttaattcctattcgtaaaattttgtaataataatcctattggttgttagaattgcgtttcattttcatgaggcaatacgcggcgaagccaccggcggaaagcagtgcgagcagtacggaccagcagattagtatcagcttggggtcgatccgtgtggtgacaaagatggcggtaggtccatccgcgccgccgatgatgccaatggagctggcagcgattccatgcggaaaaaagaaataggcaaacaggcggtcgccaagcacagctgcgcttgctgtaaggagcgcggccgcgccggacaccaaggacagtataccggtcacgcgctgcgcgatggactgattcatgctcatgcctcccatttaaatcaatgctttatattttatcaatcattgtccgctgcgtcaatctcccgctttttgaaaaaaagcttggcaaaaaactttagtcggctgtgccgcgaacagtggggcgggcgcatttcaatcaaacggccccaggccgcccccgcgcggacggcggattttttatagattgcgctccgtaatctataaaaaatctatttaaagtttgtgatttttatggattttgttggtgcggtgttgtatataagctgccgattatttataataaggggaaaacatggaaaatatttaaatctataacaaaaacagggggaatgaatatctactattgtatagctcaataaaacaggaaaggactcatgtcccggcggcaaaatggattggcctgcctggaggatacgttgaaagatgtggaccttcatgcgtagtacaaaccggatatgatacaaacaacgcctttttcggcccgtaatcggtgcggcgccgttttggacgaacatctgaaggagaagcagtcatgaagaaagcgatgaagcaatctgtcctggtagcggttttgaatacagtatccattctcctgctggtgggagtggcggtttctgtatttttgtttgtaaattttaacaagcagattgaaaaggcgaataccgaccgttttgatcttacttataatgcaaaccgatttatgaatggctcggccaatcttaccaacgctgtgcgcgcctatgccgctaccgcggatcagacgtattatgacgcttatatgacagaggttaacgagctgaaaaatcgggaaaccggtgtggccaatttacgggagatcggtattacagaggacgaggaggctatgatttccgaaatgtccgctttgtcggatgatctggtgccgctggaggaaaaggcgatggccgcggctgccgccggccgtatacaggaggcgcaggtctatgtattcagcgaaaaatacatgactgcggtcgatcagatcaacgagcttaatacaaagtttcagcaggcgcttgatacccggaccgccggcgaggtgcaaaagctgagcgtaatgtgcacgctgatgaaatgggtggtgtacgtctttctgctgttgtcagtcgccattcaggcggttcaggtttgtattgtgaaaagaaaggtgatccgcccggtgctccacatcagagatgaaatgctggagctgtccagggggaatctttccaccgtgttcaggctggaagcggacagctccgaaatcgggatgctggtggatgcgatccataaaacaaagagtgaattaaaaaaatacataggcgatatctcgttccatctggaggagatgtcaaagggaaatatgagtttaagcatggattgtgattatatcggtgattttaagccgatccggcaatcgctcaatataatcctcgattccatgaacaggaccataaggggtatcgatgatgtggcggcgcaggtatccgcacattctgaacaggtatcggatggcgcacaggcattggcgcagggcgccacacagcaggccagctcggtccaggagctggcggcgacggtccaggaattgacgaaccggatggctgaaattgcaaagaacgcgggacaggcccgcacgctgacaagccaggcggccgattccctggagcttggcgatgagaagatgcaggagatgcagcggtccatgaaggacatcgctgaggcctccgaggcgatcagcaagatcatcaaaacaatagacgatatcgcattccagacaaatattctcgccctgaacgcggccgtcgaggccgccagagccggagcggccggcaaaggctttgccgtggtcgccgacgaggtgcgcaatctggccaataaaagctcggaggcatccaagcagacaacactgctgatccagcagtctacacaggcggtagagcagggggtagcgcttgcggaggatacggcgcggacgttgaacacggctgtggaacaggcgcgcagatctaccggctatgtcgattccattgctacggattcggaggaccaggcaggcgccctgcatcagatcagcgtcggcgtcgatcagatttccgctgtcgtccagaccaattccgcgaccgcgcagcagagcgccgctgccagccaggagctgaataaccgcgccggccagctcaaggagcagatcgccgttttccagctgcgcgatcaagcgcctgcgctggacgagactgcacggttgactgctgcgcgcggtgcgggcgagggacaagcggagtatgcgcatgcatacagatcatgaaagcagctatagggattataaacaataaaaagaggggctgcccggcaaagcgggcggcccctctttcgtattggctgggatgaccgacgaccctgagcggtgtgacacaaaccttgaaagcccgctgtttctgcatacggtcttgcttgcatggagcaggatatcatgataatcggccgccgctttcttttttcggggtattctctatttcgaaaactggttttttgctgccgcggacaatatgtcgtcataatttgttttgtaattatcaaaggcatcaaaaggatgctctgaattttccaaaaggcaaaagagcgtttctgacaaaacttccgcaaagatacccaccacacgggaatgtattttctgactgtttatatacgaaacgcttccccacaacagttcgcttaactgcgttaacagctcccgatctatctgtgcaaggcggccggtttcatttaacaattttaaacagatgaaaatttcatcaaacttttgaatcatgtcctccaaattacaaaagccatattttagcgcatatctgtagccgccggcaaagttttctgtctctcctgcgtggacagctaatttcagtcttgcttttgccggcgtcatgttgttttgtttattgaaaatcatacccttcctctaattctccaattttgtaaccaagtgactttgtcaatttgtactttaaggtacggtaccattcgtcccaaatgcattccggcatcctgcccgcgatttgaattccggaacgctccgcagaggcccataaatcgattccttttccaatccatttgacatctttatcatcgcccgcccaatacggcatggatttataaacttgcagtattttatcccatgtttctttgcagaccgaataatgaatattcaaatttacagtatgttccataagttcacctacagaatatgacgattaaccgtttcggtttttacaattgaaaagtccggcggaacattttatcacagcgggcctgccgcatactgtatagatgcggctttcataaggctcgcttttttaggcaggcgatcccggttgaaaaagggtacggcaatcggtccctttgttctgcacgctcacaggcgcgcggcgtcctgatcgtggtaataagccattgcacggcgaacgaagtcctcgggcagcgcagcgtgctccgcgatttcccagggctgtgtaaggccgtcagcgtaaagcgcgtacagctcgtcgcgcgggagcagcttttcgatcgcccatttgttggcgcggtgctcgtgacgttccacaaggtcataggggctgcagacgcggtgcgtcgtcccggttgcaatgtggccgtattcatgcgcgattacagccgcttcctcggctgcggatgtgatattgtcaaaatcgacgaacagggcataggcgcccttgagttcgatggtcgcggctttttcagaaccgagcgtccaggagaaacaggacacgcccgcttcatgcagctcgcgatagaggctgagggctttgttcaaggcgaccccttctctttttcctgctgctgcttaaaaaattttgccatttcaagcaacttttgtttgttttcttctgtcaactgcttgccttcctcatacatggcataagtgaaatcgtcaaaggcaagccctttggtctgcgccggcgggtccggctgcaaaagcgcgtcgaccgatacgccaaaaaatgccgcgagacgcagcagcgcggcataatcggcctggcgctttccggtttcatagttgccgtatgcctggcgggtgatccccaggtagtcagcgacggtctgctgcgagacgcccttagactcccgcagagctttgagatttgtcatggcagccacctcacctgcattatagcaactatttgttgcatacgcaagcgtagtaacaaaatgtttcgtatttgctgttttttctattaagtttataatttttagaaacgaattgttgacaaaaggaaaaaataatggtacgataagagcaacgaaatgtttcggagtgaaaacgtacagtgccaagagccagacgaaaaagaaacaaaatgtgtcgttaattactttgggaatattttgtagttacatgatacaggattacatgtcctataaaaaggacaggaaacggaggcgcgaatggggacaatcaatgaatggacaacggcaatctactgcgtgctcaaggaagccttcggtgagacgtgcacggtcggcgacgaaacaatgcagatggagccgccttgcctggcggtgctgctgtcgcaggcttcgcagaagccgggaccgaatggccgcggtcagcgcgcggttgtgtttgaggtgcgcggccgctttacaagcgcggcacagatgcgtgaagcggctgatacgttgttctcggttcttggcctgctgcctctgccggacagcacgtatctgcgcggctgtgggatgcggtgcgaggctgcatatggcctgctgcatttttttgtgcggtatgaaggggtggtatcggccgtgcgggaaattcctgtgatggaggatctgaagcgagtgcagacgtctgattgatccggtttttacaaaagcggcaagcgccggcgcttataaaaatagctgctttgcaactattttttagcgtatctgcctgctctgcaggcaggcgcattttaattaaacggccccgcgccgtcctcggcgcggacggtttatgatttacaggttgcaaagcaacctgtaaatcatgatgaaggcgcgttgattcaagcgggttctgtgattgttttgcggcgtgtacgcggacggagcagagccaataggaacagatggaaggggggatcggcttgggaacgaaataaacaggaaagcctccggcgccgccgcggcgggtgaaccgctgcacaccaaggcgcagcttgtgacatttatgcggtaccggggacggagggatttgctggaggcgctgctggaggatgaaaaggcgtatacgcaaaaacaggtggacgccgcaattgaaacatttatgaaagggtgatttgtatggcgcttggaggcggcacgtttacaaccatgaacaaaattctgccgggaacatacattaatttcgtatcggcgccgcgcgcgtcggccgcgctgtcggaccgtgggatagcggcaatgccggccgagtttgactgggggccggagggtgcggtgtttgccgttgagtcgggcgaattcgaaaagcggtcgctggaactgttcggctatccatatacgcatgaaaagctgaaagggctgcgcgatttgttccggaatatcaggaaaggttatttttaccggctgaataccggtggggagcctgcgaaaaacgactttgcgaccgcattgcaccccggtacgcgcggaaacagcctgcgtattgttatcgaggcggccgaggcttccacagaggaaacgccggtttacgatgtttcaacctggatggatgatacacgcatcgatcttcagacagtgaaaacggcggcgcagctgcatgacaacgcatttgtacgctttcaggctgaagcgacgcttgcggcgacagccggcgcgaatctgacaggggggacggatggcacagcaggcgacgcggcgtatcagacgtttctggatcagatcgagccgtatacgttccacgcgctcggatgcctgtcggacaagcctgcggtcaaagcgttgtttacagcgtttacaaaacgtatgcgcgacgaatcaggcgtgaagttccagacggtgctgcaccggtacgggcaggccgattatgagggcgttatttcagtcgaaaacggattgactggcgcggcggacgatacttcggcggtctggtggacgacgggcgctcaggcaggctgcgcagtcaacaagagtttgacaaaccgcgtctatgacggcgaatttgaaatcgacacacagtacacgcaggcacagcttgaggaaggcattcaatccggcgggttcctgctgcaccgggtcggcgacgagacacgcgtgctgaccgatatcaacacgttcgtttcagcaacagaggagcggtcgtctgattttggcagcaatcagacgatccgggtgctggaccagatcggcaacgatatcgccgcgctgtttaatacaaaatacaacggccaggtaccgaacgatgcggcaggacgcgtttcgctgtggaacgatattgtgcgccaccaccagcagcttcagacattgcgcgccattcagacgtttgaaccggaaaatgtgacggtggaggcgggcgatacgaaaaaagcggtcgtcgtgacggaccgcgtcacgccggtaaacgcgatggagcagctttatatggtttgcgttgtcgcttaaaaaaggaggatgacagatgattgacaggccgattatgcatgcaaaggataccgtcagcgcggctttggcggaatgctatgtcacgattgacggcaaccggtactgctttatgcaggcaatcaacctggaggcaaaggttgagaagatcaaaagcgaggtgcccatccttggaaaacccggccgcggcaacaaagcggccggctggaagggcaccggcagcgcaacgttccattacaacacatcgctgttccgagagctgctgtatcgttacaagcagacgggggcggacgtctatttcgatatccagatcacaaatgaggatgcgacctccgcctcggggcggcagacggtgatcctgcgcgactgcaatgtggacggcggtatcctggccaagttcgatgcggatgcggaatatctagatgaggaaatggatttcacctttgaggactttgaaattccggagaaatttacgctgctggaaggtatgcagtaagagaaaggacggatgaaaatggcgggaggactcagcgcctttttggcgcagaacgcggtgaagcccgaaaatatcagatttgcggcgtcgcgccgctttgtggatgaggacggcaagcctatgctgtgggagctgcggccgctgatgagcgaggaggacgaagcgctgcgcaggcgtttcacccggatggtacaggtgccgggcaagagcagccagttccggcaggagtttgattcaaacgggtatctggcggcaatggcggctggatgcacggtgtttccaaatctcaacgacaaaggcttgcaggacagctacggcgtgatgggcgccgaggcgctgctcaaggcgatgctgacctcgggagaatcggccaactatttccagaaggcgcaggaggtctgcggcttcacaccgattgaggaattgaccgaacaggcaaaaaactgattgaggagggcgacggggaggcgaatgtggcgtattactgtctgcataagtttcactggccgccctccctgttcctggaaatgacagcgcgcgaaaaggcgtttgtgattgcggccatccgcaaaaagacggctgctgataagaaggaagccgacaggctgagaagcaaaaaacgctgaacacgattttttggaggggaggggatgcatacggcgacgattgtaacgacagtacaattgattgacgcgatgagtccggctttaggtatgatacaaaatgcgcaggcgcttgtggcgcagggctttttgaagattcgcaatgcggcggaccgtgcgtttgacacgtcagcggcagcggcgtttcaagcgaagcttgacggtatcggcgcttcactggaacgggttgcgcagcaagcggatctgtccgccgccgaatcgtcgtatgaacgtctgactgcgctggccggcgagcttgaaaaccggctgaaccgaatcggcggtcaatccggcggttcgggcggcggttcgggcggagattcggacggaggcgggggcggttccggcggcggacaggacggcgcggcaaagcaatgggatactctaaaagaaaatgcggaaaaggtcggggggattatcaagaaaactgcggagcttgcagaccaaacggcgcggacgaacgcatatattgcacagatgaacgacggtttgcagaccgcggaccagcttcaggggatgctgttcacagccgcgcagaattccgggacggcctattcggaggtggttaagactgtcggcgcgttgaacgcctcggcgggcggtacgttctcctcgaatcaggaggcggttgcctttacggagctgatgaacaagcagttcgtcgcgagcggcacggatcaggaggatcagtcggcggtcatggggaaactgacggccgcaatgggagagggcgtcatcaatacggatatgttctctgagcttgaggcgcggattcctcaaatcggcacgctgctgtcaaacgcgtttggaatcggtcaggccgagcttgatgagctgatcgccagcggcggacttacggcggagctgtttaaaaacgcgatgcttgcctcgtctgacgagatcaacgcgcagtttggtgggacgccgattacctgggcgcgtgtgtggacgatggcgacagatgaattgttgatgacgctgcagccggttttgggggcgatcagcgggcttgcgcagcatgcggatatattgatcccggtgatctttggcgttgcagcggcttttcaagcatacgcggttctttccggcattatggaggcaaaatcatggttggcgggcggagcattcaataatctgtttgcagtgctgaaatcgaatcccattctgatgattgcgacagcaattggcgttgtaatcgctctgatttatgcgtggatacagtccgtcggcgggatacaggttgcatggatgatggtgaaaaatgtgctgttgtctgtttggggagtaattaaaatcgcattttttaccggcgttttttgggttttgaatttgatagacaagatggtgctgaaatggttgacaatggctgtgaatctgcaaaatacagcgggcgacatgaaggctaatattctgatgattctgcaagggatggttaacggcgcaatcgacattatcaataagtttatcggggcgttaaataaaattccaggcgtgtcaattgatacaatccagcatgtgacgttcggtacggaggaaatgctgaaaaatgaagcagagaaacaggaacgcaatgagctgctcaatgcagcggcagaggaagttgaaaaccggagggccgagcgggaacaaacgctggataaaatgaaggcggaggaactgataaacgcggcgaagcgtcagagcgaaattgaagcggcgcgaaaccaggccgacgccaacgcgcagacgaacagctatctgccgtcgggcattgatccgaacggacagggcggtaacggggcaaacggttcgggcaatggattgggtggtctggaggacccgtatggagaggtacttggaacaatcgccgacaacacggcggcgtcggcggattcattgaacctgaacaacgaggagctggaatggatgcgcgaccttgcggagcaggaggcgatcaaccgttttacaacgacggaaatccgtgtggatatgggcggcgtaacgcagaacgtggcgtcatatctggacgccgagacgctgacgcaccgcatggtggaggccatcaacaatggcgcggcaacgggtgtggaaggagtgtacgcataaatgccgtatacattttatctggatggcgtacaattgccggtgacgcccggcaagctgcaagcacagattggaaaccaaaacaagacctacagcctcatcagcggcgacgagatcaatgtgctcaagacccccggactgatggagctgtcgttcgatatgcggctgccgcagatatcctatccgtttgcgcgtgacgatgacgcggcgccgtacatcgaccggcttgagacgctcaaggagagaagaaagccgtttcgtctgatcattacgcgcacattgccgggcggacggatgctgttcgatacaaatatgcgggtttcgctggaggattacacgctcaaggaggatgcggacgaggggtttgacgtgatagccagtttaaagctgaaggaataccggccgtatgggaccaagaccatcccggtgcctgacgatttgctggccccgccggacagcggcgcgccccggccgggcgacagcccgccggcagcggggacgcatacggttgtggcgggcgactgcctgtggaatatcgcgcagcggtatcttggggacggcagccgttatctggaggtgtacagtctcaatcaatccgttatagataagggcaacgaaggcacgggcaacccgaaatatacgatatatccgggacaggtcctcaagctgcccgcagcttaagggggcggcgttatggatgcaaagctgctgatccgcaacggcggcctttactatgagccggcggttgaaggagcggtttcactcgatttggaacggcgcggcgcgcccggaaagctcacgtttacagctattgacgacagcgcgcttaaagtggaggagggcaaccgcgtacaactgaccgtcgatgggacggaggtcttttccggttttctgttctcacggcagtatgatcaggacggccaggtcaaaatgacggcgtatgatcagctgcgctacctgaaaaacaaggatatttataactatgagaatctgacggcaacgcaggtcgtggagatgatcgcggacgattatatgcttcaaaaaggggtgctggaggacacaaggtgggtgatcggcaaccgtgtggaggacaaccggtcgctgttcgatatcatcctgtcggcgcttgatctgacactccagaacacggggcggctgtttgtcctttacgatgagtgcggcaagctgacgctgcgcgatatcgaaaacatgaagcttgacttgctcgtcgacgcgcagacagcgtccagttacgattacacggccagcattgattctgatacatacaatcagatcagtctggtctatgacaatcaggacgccggccggcgcgaagtcaccggcgtgcgcgacgccggaaatattgaccggtggggcgtactgcaatacttcgagaaggttcagaaggatgagaacgccggggcgaaagcggcggcgctgctccagctttataatcgcacggcccgcagtctgacggtcaagggggctcttggcgacgtgcgtgtgcgcggaggttcgtccgtaattgtgcgcctgacgctcggggatatcgctgtgagcaattacatggtggttgaaaaggtcagccacaaatttgacacgcagttccatacaatggatttgacgctgcggggaggggagatcaatgtataacgaaacagaccttgcagccgctatccgccggctggcgattggggcggttgaatgcgggaaaccgagcgcgctatgttacggtacggtgttgagcgccgcgccattgcgggtgcaagtggatgaaaagcttgtgctcggttctgcacagcttgcgctttcctcgctcgtgagcaatttttcagttgagatgcaggtgcggcacgagacggatgaagcggagggacacagacacgcgtatgagggcaaaaaagagtttactgtgctgatggggcttgcgcccggtgaaaaggtcgctttgctgcgcgcgcagggcgggcagcagtattacatactggaccgtgtgaggtgatggggaatgctgccggcaacaggcggatttgaaaacttgaggacaaaaacgcggcgggcaagccggacctggaagctgaataccggcgcggggacgattgccgggacggcggacgaaaaagacgcgatgatgcaggcgatttatctgatcctgtcgaccgagcggtatcaatacctgatctacgggtgggattacgggattgaaacaggcgatttgatcggccggccgcccgattatgtgcagtcggaattaaagcggcgtatccgggaggcgcttatgtgggacgaccgggttacggcggtcgacggcttttcgtttaccgtttcacacaatcaggtgagatgtacctttacggtttcgacgatcttcggcgatgtaaaggcggacagggaggtgacggtttgaatgtttgaggaacaaacgtacgaagcgattctgcggcgcatgatggccgcggctgtcgaaggacggccggaggtggacacgcgcacggcgtcgattttgttcagcgccctggcgccggcggccgttgagctgacaaatctgtatatcacggcggacagcgtgcttgacgaggcgttcgcggacacacagtcgcgcgattttctgattcggcggtgcgccgagcgcgggatgcatccgtatccggcaacagcggcggtgtggcgcggacagtttaataagacgccgccggtgggcacgcgcttttctctggagggattaaactatgtcctgacagaaagcatctcggagacagatgcgcggctggaatgcgagacgccgggcgaagccggcaacacgctttcggggcggctgataccgattgaatacgtcgcgggcctgacgaaagcgcagcttgtggagcttttgatccccggcgaggatgaggaggacacggagcatctgcgcgagagataccttacgtcgttccggtcgcaggcgttcgggggaaacgtacaggactatctggataaggtgggcgcgattgccggcgtgggcggctgcaaggtgtaccccgtttggaacggcggcggcagcgtgcgcgttgtggtgatcgacagcacctttgcgccgcccaaacagacgctgatcgacgcggtacaggaggcgcttgacccaaagggttcgtccgggcaggggtacggcatcgcgccgattgggcacacagtgacagtggacggcgtaacggcggcacgcatcgatgtgaaaaccagcctgaccttgcgggagggctgggcgttcgaggatgtcaggccgtatgcggagcaggcggttgacgcgtatttccaggagcttgcaaagcagtgggccggttcggacgcgctggttgtgcgcgtgtcgcagattgaaacgcgcctgttggaattggacggcgtgatcgatgtgggcgatacggcgcttgacggcgtacagggaaacaaaacgcttggggtggatgagataccggtgcggggtgatgtggttggataggaagctgatcgattatcttccaccggtactacagcaaacgcgcgagatgcaggcggtcatggagggcgaacagcccgcggtggctgggttgtgggacgcgtggaaaacggtgctggacgcgctgtttgtccggtatgcaaacgaacaggggcttgcacggtgggagaggatgcttggaatccggccgcgcgggacagacagcatggaagtgcggcgggctgcggtattggcccggctcaatgaacagctcccgtttaccgagcggacgctgcgcctgatgctggacggcgtctgcgggccgggcgggtacacgctggagatcatttatagggagtaccgcgtgtttgtacgcgtacatctgtgggagaagcgggcgatggacgaggcggcggcgctgctcggacgtgttgtcccggcgaacatggtcattgacctggggctgcggtacaacacgcacaggatgctccggccgcggctgcacaggatgctgcgcgggacgacacaccgcgcgctgcgtgaggaggtgcttgcttgagagaaagcaaatggtatgggcttcggattccggagcaggatgacgaatacaatgtggacgattttggagcggcgttcgacaaaacagacgatgcgctgcaccggctgtccgcggcgctggagacagaaagcgagctggtgcgtatcgatcacgggcttgggacgtatccgcaggtgacgctcggcgcgctgcaatacgggcttggcgtggcggggcttgacgaaggccccttaggcggcacggacaccgcgcagtatccggcgcgggcggtttatcacagcagccggtcgctgaccgtgatgacgacaaaaagcattgcacagctcggtacagaaccaacgctgcacaaaatgaacgaccgcgaatatacggtcacatggccggacaaccagacggacagcctgtatatccggctgatataggagggattgactttatgggctttgagactttcaccaaggggatgcaggacgcaaacgaggtgctcaaccgcaattttgccgctgcagagacgcaattgtcaagtaaggcggaggcagagccgccgcaaaagtttgaactgccgttggcggaaggctggacaaaataccagcagccttactatcagcgaaatgcattcggggaagtgaccatatggggatcagtgaaaaaagattctgcgatcgaaaaaagcgacgtaatagccacactccctaaagggttttggccgccggctccatttgaggcgccggcgatgaaatttgttgacggcgcgccaactgcggtcatggtatttgtgcatggaaacggacaaatatcgaccagcgccacgacatcgacaggcagcgcggcactgtcttttataatcacatatgccggacaatgaaaggggacgatcatgtgaattatgcacattactgcgttattgacgcgcaaaatgcatacaagatgtttgtgctggttttgttggaacaggatggaaccggtatgcagaaagaagttattcagtattatacgctttcggaaggagaacggctgatagatgcagcgccgcctgtgatgcgtccatatatcggcgcggacgggtttatcaagccggtgtgggaaggctcaaagtggatggaatccgctacgaatgaagaaattacggcgtgggaggcggagcacccagccccgccgtccccgacaccgagccgggaagatcgggggcttgccgatatagcgttgaagctggcgcagctggaggctgccataaaacaattgcagcaatccaattccgtgttgatgacgcggcttttaaaagtgcaggaaggggtgaagcagcatgtttgattggtatgaccagatcaagatgtattatgatcttgggatttacggcgcggatcaggtgcaggtatttgttgacgcaggctggatcagacaggagcagggggcgaaaattacagggcggtgatgggaggcgcttgtttggacgccttaaaatacaggaaagaggggagaaatgggctttgaactttttaccaaggggatgcaggacgcaaacgagatactcaaccgcaattttgccgctgtggagacacagttaaacggaatgtcgatacagttatatgtgtctataaatggcagcgacgaatccggggacggcacgcaagataagccataccgaacaatttaaaaagcggtagacgcaataaagccttatcatacagacgcctctattatcataggtgccggcgactatgatgagtcagttgagattagaaataaaaccgcaagtattggattatccagagagacacgcgaaaacaaagtaaaaataaaatatataggggccgcttactgccggcaaatctggctggacggattgagtttcgatggaacgggcttggaaggtgacaggccatgcatcaatgtaatgtgtgtaaataatatgcagatacattattgtgagatcgccggggggcctgcaataggcgggattggtctggattcggcaagcgcgtatgtggccaacacatcgatatcaaattgcggccgtgccattacagttatctacaattcgctattaaccgcccgtggggtcggcggggctggcaatcagattggttactccgctcacagttcgattttgaatattaccggctcgtctttgcaagcgacaacattaaccgaaaaacgaaatggtggaatcatttataaggatggcgtactggtatagtagacgcaatcttggtgtggcccatacgtgtgacaggacagtcaaggggatggatcaaatacagttgcaaaacagagcgggggatgggatgcgctatgcatcccatcccccgctctgttttgcccagcaggcttttgctggatttaaaagttgttcaacagccttttttagagtatcatccttctctgcattactggagaatatgacatagacaaagccgggaaatttgctttccggaccggtgtaccagaccggtccgccgggctgaagatgtcctatgacggttgcacgcttgacatgaagcgcctttacacccacatcgctggaggtaatgccgcctttggcaatgagaaaacggggacgcaccgccggcccatcacgctggtaactgccctcgggatttccgcggcgatgcaaagctggtcctccggatcgccagggggcagattccgctgttctggttttaaaataggcgggaagccatttaagggctttcccgccttgactgcctgccggcaaaggcgaacgggactttcaacgacggcgcgttatgcgccgctcatcttgccgttgactggctcgactggccttgctatttccccgataaatgagaactgttcgctagattgcatccgtattaaaaccgtcaaagttaaatattttttgaactggctcgtagacaaaccatgcttccattcctaaatagtcatctatttcttttcgtgcacatcctctcggataataacctaaaaagtgaagatataattgaactatgatttccttatcttgatttcgcacagtaacagaggccaaataccactcgcctgttaaatcctttatacggggaaaagtttcttcttccatccaatcatctgcatctaggtattcttcacattctttaatggctgtttcaatcaatttctctctgtggttgagatagaattcctttaaatgccctgattcaaagtccattttgggttgcagctttcggtcataatctgtatatgtattttccggattaggatacggcataacaatttctttgaattttaacggcttttccattccctttgctctcccatacaaattccgatttattgctgatttcattatagcatggtggcattataaaatctacgaaaatgtatgtggctgtggatgattaagtacagaaaaagtcttatatttcatgtgattacaggcgtagagcagggaagatagtaaaatgtatcgcctaccctgaaaaatacatttctaattgtccgtgttacctttgccatacctgtataaccgcgctgcaaatataatgacaggcgttgcctgtgcagcctcttgtaaacagtactttcaatcagtgtttatacaaactgcctgctgaatattaaaattttgttaatatcggatgtgcggttcttgacaaaaggagttttacgcgtataataaattgttgttaaacagttttaaaaagaactgtttttctgggaaccattaaatggagggacgctggtgatgagccgcacaacggagtttttgatgaatatccggtcgatcataaagctgcatgagagcatgctgcgggaaatctgtggggaataccagctcgcgctgatcgaggcgactattatcagctttctgcacaataatcccggcaaggacacggccgccgatattgtggagctgcgaatgctgtccaagggaaatgtgtcccaagcggtggaaagcctgatccagcggtccctgctccggcgggagcaggacgcggtggaccgcaggcgcatccatctgtttttgacgccagccgccgagccgattgtccagtcgatgcagcgcctttgggcgcggtttgaggacgaaatatttgccggcctgtcgtgtgatgagcgtgcaatatttgaacgggtcaacgaccggattagcgacaataccaggcgggctatggcaaggaggacaagaaaatgaatgacgaaaaggatttcctggggacacagccggttgggaaactactgatgcggctggcgcttccgacagtgaccgctcagatcatcaatatgctttataacatcgtggaccgcatttatatcggccatattcccgatgtgggagcgatggcgctcaccggcgtgggcgtctgtatgccgttgattatgatcgtgaccgcattcgccgccttcgttgggtatggcggcgctccgcgggcatctatctttatgggcagaaacgatcaggatgcagcggaacagaccctgggaaactgttttgttgtacagattgccgtctcggctcttttgacagcggcgctgctgctgtggaaccgtgattttctcatggcgttcggagccagcgagaacacaattgaatatggtgtcgcctatatgaacatctatgccctgggaaccgtatttgtacagatcacactcggtatgaatgcgtttatcacagcacaggggtttgccagaacaggtatgctttctgtgctgattggagcggtggccaacatcattctcgatccgatctttatttttggcttggagatgggcgtgcggggcgcggccttagcgacgattatctcccaggctatgtcatgcgtctgggtgctggcgtttttgctggggaaaaaaacgcgcttaaaaatcaggatgaaaaacctgcgtctgcgggccaatattattttgccaagcctggcgctcggcctgtccacatttattatgcaggccagtgaaagcgtcatttccgtctgttttaattcctcgctgctccgctatggcggcgatatcgccgtaggcgccatgacgattctaaccagcgtgatgcagttcgccatgctgccgctgcaaggtctggggcagggggcgcagccgattatcagctataatttcggcgcgcagaatgcgggacgggtgaaagacgccttcaaactgcttttgaaagccagcctttgctattctgtcctgctgtgggcgcttgtcatggccttcccgcagttgtttgcggccttgtttaccacggatccggcgctgcttgaattcacaaaaacggcgcttcgcatctatatggcgtgcctgctgctgttcggcgttcaggtggcctgtcagatgacgtttacggccctaggcaatgcgccggcctctattattgttgcagtaatgcgcaaatttgtccttctgctgccgctgatcttcctgctgccgcagatctttacgtccgaccaaacgacagcggtctatctggcggaaccagtcgcggatttttttgcggtcagttttacggcggtcctgtttaccttccagtttaagagggcgctgaaaaagatagatggcggaaaaaagcgcgccggtgcgcgggatacgaactgacgcggaaacgatcagtgaaagaaagcggccgcgctgcccgcaatcgggcagcgcggccgctttgtgcaaaagagacaaaaaacgaaaatacgctttgcgatatcaaagggaaagccgtttgatacgccgttttttaaatttcaacaatgagattcgaaattctacgtgactggccattcggctttgcagaaaagctctgcaaatttaagagaatatttatgggcaatcaaaaacggaacagacatgtaaaatgtctgttccgtttggtgggagaggatggattcgaaccatcgaagtcactgacaacagatttacagtctgccccctttggccactcgggaactctcccatatgaacttgtttgacttgaaaaaacgatggagctggtggacggacttgaacccccgacctgctgattacaaatcagctgctctaccaactgagctacaccagcggctgcatcccttcatagcgacggatattattttagcatatcaggaaacagatgtcaacaggtttttcgataaaatattccaatgcaccgggaaagagcacggggatctgtttttgaggaatcttttttaaatagcgggaaggccggcactggagaaatccacgccagccgcgcggcatctgtcatggattttgttgggggaagtcggagcgccgccacaggggatgccttgcagcctgtgggctgctttggcgcgcgcaatccgtgcgcggattgctccaccgccgggcgctgcgcttgcccggccgtctattcggggctttccggtgctatagcgccgggcgcggacagccgcggcaaggccccttttcgcgccttatgggacaggggcaggccgtccctatcccgtggacacaaccccggggcaggcgcagcctgtataaacacagcgcccaacctgctgttcgcggcgcagcctgcatcaacgcagcacccaacctgctgttcgcggcgcagcctgcatcaacgcagcgccaaacccactgttcgcggcgcagccgattaaagtttttcgccgaagccttttttcaaaaaggctggagtgcagccaacgaaagttttttgccgagcttttttcaaaaaggccgaagggggttatgaggaagcgccgaagtatttgcgcacggtggagacataatcctcggacagctcgaaggaaaggctgtcagacatcagcgtgccggcgggggcgaggctgccagcaaccgatatgtcgccgagctgggaaaggaaatccgcagcgtcgcggcgcagctcgaaatcgacataggaaagatctgtatccacaaggtttacaataaatttgaacagcccgggggaaacatccttgccggcggaatcgatgttttggttgacgatggcagcggtcagctcgccgagcagggcagcgcgttccaccggaccgccttcaagtgatggagccgcaaagaggtcggcgacatcgcggccatcgagacggcggcgtccggccggaatattgatgtcgtagccatcgctgtggtaggaaacggcatagggcatttcaaacacgacagaaccggtcttatcggcaattcggatgaaaatatcgcgtgacagtgcagcgtagcggtcaactgtgatgccaaaccgctcagataacgcctgctttacgccgttgccgccgccgcgcgcccaggcgcgcgcgagagtcatcgtctcgcctttgtatgggacgagcgtttccggcggcagtacagccagcggaacctggccgtattgagggttgaaacggatcagcaggaaatcggatgcgccgccggatgcgttttttccgataatcgccatggtcaggctttcggaagcggccggacggtaagatggctcctgtgcgggcagctcgtcggtatggttctgcggcatggtcggctgcacagccagcacagtgccaaccatgatcagcgaaagcagaagcgccgccaacgcaaacgtcagcaggaatacacgccccttgttctgttctgtccgccgcataaaacagtctcccctccggcgccttgccgtgcctgttgtattttgttcccatatagcattggcacaaatgtatacagcttattcattgcatggagcctgtccatatggtaaaataaccgcagggcggtcattttaccttttatggccggggcgatgcgcgggcgcagcccgctgccgccctgatggccgattttaccacgccgcttcgcggacatggtaaaataaccgcagggcggtcattttaccttttatggccggggcgatgcgcgggcgcagcccgctgccgccctgatggccgattttaccacgccgcttcgcggacatggtaaaataaccgcagggcggtcattttaccttttatggccggggcgatctgcgggcacagcccgctttcgccctaatggccaattttaccacgccgctttgcggatatgaaaacctgaaaatgcaggcggtgcgtgcctgtaaatcggaagttttatacgggaggtattttaatgataaaattatacgaaaccggtgcgtattacgccggtgggaagctcattccggacgacgaaaatgccgccggggcgctggccgcacgcggtctgacggctgaccgggaagccggcgcaaaaaaaacgatcgcgtggtcaattctcgaggcgcacaataccagcgggaacatggacgagctgaagatcaaatttgacgcgatggcgtcgcacgacatcacgtatgtcggcatcatccagacggcgcgcgcgtcggggcttgagcggttcccgctgccgtatgtgctgaccaactgccacaacagcctgtgcgccgttggcggcacaatcaatgaggacgaccacatgttcgggctgtccgccgcgaaaaaatacggaggcatttatgtgcccgcgcatcaggcggtcatccatcaatatatgcgcgaaatgatgagcggctgcggaaagatgatcctcggctcggacagccacacgcgttatggcgcgctcggtacaatggccgtcggcgagggcgggccggagctggtcaagcagcttttgaaccgcacctatgatatcaagcggccgcaggtggtggccgtttatctgaccggccggccgcatcccggcgtgggtccgcaggacgtggcgctcgcgattatcggcgcggtgtttaaacgcggttatgtcaaaaacaaggttatggagtttatcggcgacggcatcgccagcctcggcgtggaataccgcagcggcatcgacgtgatgacgaccgagacgacatgcctttcctccatctgggagacggacggccaggtttccgattactttgcgctgcatggccgtcccgaggcgtataagcggcttgcgcccaaggacggggcgtattacgacggcgttgtatatgttgatctggccacggtcaagccgatgatcgccatgccgttccatccgtcgaacgcatatgagatcgacgaactgaatgtaaacctgatggacattctcgcgcaggtcgaggaggacggcgcgcgtgcgcttgacaatcccagcctgaaatttacgctgcgcgacaaggtgaaggacgggcgtttggtcgtcgatcagggtgtgattgcgggctgcgcgggcggcacatacgacaatatctgcgacgcggccgatattctggcgggccattcgatcggcgtcgatgaattcgcgctgtcagtttatccgtcaagtcagccggtctatatcagtctggtggagaacggggcggcggccaagctgatgcaggcgggcgcgacgatgcgcacggcgttctgcgggccgtgcttcggcgcgggcgacgtgccggcgaacggcgggctttccatccgccattcaacacgaaacttcccgaaccgcgaaggctccaagcccggaaacggccagattgcctcggtcgcgctgatggacgcgcgctctattgcggcgacagcccgcaacggcggcgtgctcacgcccgcgaccgaccttgatacagcattcacaaagcccgtctatatgttccacggcgaggtttataaaaaccgcgtctatgacggatggggcaaaccggagccggagctgccgctcaagtttgggccgaacatcgccgactggccgcagatgtcgccgttgacagaacatctgtttttggaggctgacgcgtacatcaccgacccggtcacgacgaccgacgagctgatcccatcgggcgaaacgtcgtcctaccgctccaacccgctgaaactggcggagttcacgctctcgcgcaaggacccggcgtatgtggagcgggcaaaggcgtcgcagaagtgggaaaaactgcgcctggaaaaaggcacgtcgtttgatgacagcgacccgtcctgccccatccatgtgatccgctcaatcgaaggcttcgccgatatcgacagcggcacaatcgggtgcggctcgctcgtttacgcggtcaagcccggcgacggttcggcgcgcgagcaggcggcctcctgccagaaggtgctcggcggatgggcgaatatcgcgcgcgaatatgcgacaaagcgttaccgctccaatctgatcaactgggggatgctgccatttttaatcgacggggagccgccgtttgaaaaatatgacaatattttcataccatatatccgcagggcggttgctgaaaaacgcgcttccatcacggcctatgcgcttaccaaagacggtgtcaggccgttcgagctgacgctcggcgatttgaccgacgatgagcgcgccattatcctggctggctgtctgatcaattattaccgcgcgcaaaaataaacgccggcctgattttcacgaaaaaccgcgccgcctgtacacggcggcgcggtttgaaacgatgatgcttatgcggcggcgtcaatgcataaaattttaccacaaccacccttttgttttgtgcgataagtccgaatatctctattagaaatgtgatcggattttgtgcaaaagggagcgtcggcgatgcggatcgtaacaggaatcgggcagacaggcggtcatcagaacgcatatcaggcaggaccggccgggcaggaacagcaggcggccggcgcacaggagcgcctgaaggacctcctggcgcgccaatctgccggcgcgggggcgtccgccggcggcgccgggggaaaaccgaaagcctcgctgccggacgatcaggtcgggcagcttgcggcagagctggccaacgcgcggtcgcggtttgacgtgcagcaggtcgcggggaaagctatgcgcgcgctggcaagcctgcggatgacggcggcgctttgcgaaggcagggacaaggcgaagatcaaccggatgatcgcgcggatggaaaagctgatgaagcgcacccgcgtcaagatccgccatcttgacaaggaggaacagttggagcgccaaaagcgccgcgctgaaaaggagcaggaacagaaaaaagcgggaagcctgcgcgatgaactgaacagccgccgcaaaaaacggcgcagggaggaagcaaattatgcgatgaaggaagccgccagggaccgcgaggccgcgggcagcggcggattttttgaaaatacggcggcacaggccgccgcgccgctgccgcctgcggacagttttgcaccggcgcaggccggcctggagacggccgcggcggaaggcggggcgttggatgtatctgtatgaaaaagggggcgttgttttgcgccgtgatcccataaaatttctccggttgttttttatgattttttcgggcatcggcttgattttcacagcagccggcatcattgccgccgtcctgacgcggatgtccccggcctgtgcgttcctgtcggtagcacacggcgcgctctctctgctgatcggcctgatcggactgcttgtcatcgcccggcgggcgcgcctgcgccagtggctgcttgaaaacgggcgcccggtcaatgcgcagttggacggctgtgtccgtgaatatggggtgcgctattgcggctgcatcccgtatgtgatcgaatgccactacaccgacgcggagtcgcgcacgatctatcgatttcgcagcgcgtatctgtggagcgatccggagccgttcttaaatgggcgcacaacggtgcgcgtatttgtcgacccgcgcaattaccgccggtaccttgttgatacgcggggactgtccggcggctataaggtcgtgggatgaggataagaaacagacggccaaaaatttttgaaaaccaaaagggccgcggctgcctgaaagcagccgcggcccttattgacacatcaaacccccgccatatcgatgccctgccagctgtaaacccccgtcatacgacaaggtgggtacgcccgcttacgcgtttccagctcccttcgtccctttacaggggaggtctgcactccgcgcgtgaaaacgaagctcccaaagtacagttgttggagtataaagggcagggctgtcgggtacagcagggaggttttgcaaatcctggtttattcgccgtcctcgccctcggtgaactcaaagctgtcggacaggcgctccatgaacacagccgcaacctggtcaaattcagcctcgtcctcgatggcctccagaaactcctcgtcgccgtccataacagacttgagcaggaccagctcgccgtcgtcgtcgtggtcgccctgcggcccgtcgtttccggcaatcagcgcgatgtaacgctgctcgccgagctcaagggtgtcgatgatctcaaattcatgctcatttccctcatcgtcgatcagcgtaatcagctccggcccgtattcctcgttttccagatcagccataagcaatgtactccttttcgcgtgtgccgcgttttgtttacagtaacatgataatgcatcggctcaaaaatgtcaaatgctttctttgcagcatattgtgcatatattaaataacaatttgttgaaaatatatattgattttttctgattaaacgcatataataaaactacagaaaagggaaacaaaagacaattacagatagaaaggcggtggttcccatgtacaaagattcacacagtttctcatttgcgtcgggggactgtgcgccggacagcgattctttctagatggctatttcggaccatgtggttgcaggtttcgtcccgataaaacacaagctccgcagacaatccaaagttcttaatgcagcaagcaggaattgttaacggctattctcatcaaaaggataccgaaaggaagatgtccaatcgtaagaggcgagatcattccaatgcggacaaataatctgtaatcaaagtgttccaatcataaacgggattatccaaagcatcgaaaaaagaaaggttccaaagcggcgcgctccccaccgccggcacgatcggtcgggtgaagggctgagaatgttggcgggacgcaaatgcagggaataaaacagaatagatatccgtgcggttgattctgacaacggcccgtatgtcggctaggaagacctacggatcggaaactctgcccgattggcttgcacgaagcaatcgaaagcaagggccgacaggcccatccgctgtgacagtaaccgcagcgtgatgtttttagagtgttacttgcagataaaaggtacgagtttttcatacgcccattcatacgagataatcgcatacgacggccgaaagaggcttcgtatcgattggtgcggtccaatgtaaaaattaaacaacggcgccggtaataaccggcgccgttttcaatttggaaaaagacaaaagtaaacttactatgaatatcctgcccagcgaattgatttcgtgcgaatttatgttaaaataaaatggccagagcggtgcgcgggcgcggcccgctcccgccttgatggccgattttatcatgtccgcaaaacggcatgataaaatgaggagtatcggcgcctgattttagggaacaaacggtgaagcgtgctgctacgcgcaccgtatcacatatccattacggaggtaatcgttatgaaaaaaatagccatgctcctttgcgcggctctgatgatttccatgctggcttcctgcggcaaggacaatcccgaaccggcaggcgatacatcgtccgccgcgtcaaccggtgcgtcgcagacaacgagcatgccgtccacaccggctgaaatctatgggcataacatgcagatcgatgagtcagcgatcagcttaaagcagttcgaaacgcccgctgcgggaagtaagatcgcaaccattaaaacaagcctcggcgatattaaaatcgcgctttatcccgacgaggcgccaaaggcggtcgaaaactttattgcgcttgcggaaaagggatattataacggactcaagttctacgaggtcgtgccgggcgtgcgtgtgacaacaggcgatccaaacaatgacggaaccggcggcgacagcaatgcaggcggcgtattctctgacgaatacagtttgaatctgtggcattttaatggggctgtggccatggataacggcggcgcgcctaatcagaatacgagccgcttcttcattgttcaaaacagtgagatcacaacggagttggctgacgaaatgctcgacggcgggttcccggaatcggttgtgcagaaatatctggatgtcggcggcgtaccaaattatgatttccgcgatacggtgtttggacaggtgatcgagggtatggatgtcgtggagaagattgctgctgtcgagcgcgacggcgagaataagccaaaagaggatattgcgatcacatcggttgaaatcagcgaaatgtaactttttatagatcgcaaaacgcaatctatgaaaaattggccggtcgtttgattaaaatgcgcctgtcggcagagtgggcagatgcgcaaaaaaatagttgcttcactgctattttttatttataatttggacgcgggatgcgcgtgcatcccgcgttttttcataaggaggcaatcatagtgaaaaatcgtttcctagccatgcttctggctatgcttacaatcgtttccctggcagcctgcggtcaaaaatctgacgctgccatcgaggaaatcaacagctttatcagcgaaaatctatctgcggatattacaagcgacgagcattatgaatgtgttgtaagtgcggggagtgaaaagaatatctacaatgtgtccctgacgctcaatttgtcctctgaaggtatgagcgacgaggatctgctcgacacgacggcttttgaatcgagctacctgattgatgacgcatttgccaacgcaccctacgcaatcgattataccctgaattatctcaaggacggcaaggcgtttgccactgtcacacgtgcccacaacagcaaggaatttgtacgcgattacaacggtacgcaggatgtattccaattccaactgtaattcgcctgtggtaaatttcgctggctgcgccgcggatgatggagtctgctgcgattaacacaaaaacggggcgcctcctggtggatggaggcgccccgtttttaatccttgctgtcgagcttgaggactgctgtgaacgcttcgggcggcacggagacggacccaagctgacgcatcttctttttgccttccttctgtttttcaagcagcttctttttgcgcgtgatatcgccgccgtaacatttggcgagcacgtccttgcgcatggcgcgcaccgtttcgcgcgcgatcaccttgccgccgatcgcggcctggatgggtacctcgaacaactggcgcgggatattgtcgcgcaggttttcacagatacgccgcgcgcgcggatacgccttgtcggcgtgcgcgatgaacgacagcgcatcgacaacctcgccgtttaagaggatgtcgagcttgacaagcttcgaatcgcggtagccgcacatctcataatcaaacgacgcatagccgcgtgtgcgcgacttgagcgcgtcgaagaaatcgtagacgatctcgttgagcggcagctcgtaatgcaattcgacacggtcggcgtcaagatattttgtgtcgatgtaaacgccgcgccggtcctggcagagatccatgatgttgccgatataggctgttggagtgaaaatgttcgccttgacaaacggctcctgcgcggtggtgatctgtccggggtcgggatagctggcgggattgtcgattgagatttcctcgccgtttgagaggatcagcttatagacgacgctcggcagcgttgtgacaatatcgagattgaattcccgctccagccgttcctggatgatttccatatgcagaagccccaaaaatccgcaccggaaaccgaatccgagcgcgacggacgtctcaggctcaaaggaaagggacgcgtcgttgagctggagcttttcaagcgcgtcgcgcaggtcgggatattttgcgccgtcctgcgggaagatgccggaaaagaccatcggcagcaccttgcggtagccaggcagcggttcggccgcgggattggcggcgtccgtgacggtatcgccgaccgccgtatcgcgcaccgttttgatcgacgcggtgatatatccgacctggccggcaaacaactcgccgcgcgggacaaggctggtcgcgcccatcacgccgcattccacaacgtcgaattccgcgccggtggccatcatgcggatgcgcattcccgggcgcacgacgccgtttttgacacggacatagacgataacgccgcggtaggcgtcatagtagctgtcaaagatgagcgcctgaagcggcgcgtcctcgtcgccgcgcggcgcggggatatcagatacgacgcgctcgagcaccgcatggatgttttcgcccgttttggccgagatgcgcggcgcgtccatgcacggaataccaataatgtcctcgacctcctgcgcgacgcgctccggctcggcggccggcaggtcgattttgttgatgacgggcgtgacctcaaggtcgtgctcgatcgcaagatacgtattggcaagcgtctgcgcctcgatgccctgcgacgcgtcgacaaccagaatcgcgccctcgcacgcggcaagcgaacgcgacacctcgtagttgaaatcgacgtggccgggggtgtcgatcagattgaactgatattcctcgccgtcgtcggcgcggtaggtcagcgacacggcgcgcgccttgatggtgatgccgcgttcgcgctcgatgtccatattgtcgagaatctggtcctccatatcgcgctttgagacagtttctgtcaattcgaggatgcggtcggcaagcgtgctcttgccgtggtcgatatgcgcgatgatgcagaaattccggatgtttcttcgtttgtccatgttttcccgccgtttccgccgcagggcgtttgctccgttccctgggcaactcagtatcactataatattaaattatagcatacctgccgccgcctatgcaatacggggcgcaggttcttcctttttacatttggactggcgggtgatggcttcgtcaatttcactatgcgttgattgaagcagaaaaatatgataaagtaaataaaagtataaatcagaatttaggggaaattaacagttgaattttattgataaagcatttagaaataatttacacggcgatggtttcttacaggcaatggccggcatttattcggagagagaagtccggcaagtgttaaatcgttatccgcagtttgtgaaagacgtaattcttattattgattatgatacagcgatacaaatggaaggcttaggcgcagtgatatatggtggtttagagaaagagctgccgaaaattttacaggcattggataattgcggcgcgggatatgaggcggatgtattgcgtaaggcaaaggcgatggggcaggaaaaattcgaacaagaatatgccggcctctatagcaaattagccatcaataatgattatgatggcttttgggatttagtgagaaactatattgatatctcgttgcaggcataaaactgcaaatttgacgagctttctatctgtgaatatacctcctttcgttacttcggcaaaaaaggttattgatatcctgaatcagtccaaaaggtaaaagggagcgctcctgcggttgtgtttatgataacatgctggtatcatcgtaaataaaggtaaaatgaaaaggagaatacaaatgccccaccctggaattatttttgctgcgtgcgcctgctgcgcagccctgactttctctgcctgtgcgcccaggtccgaggcagagccttccgccgcggcgtctttcccaattgaggcgtcctctgccgcgggcgtctctatcgtcgaggcgtctgcgggtatagcggcttctgatgaagatccggctgcgtccattatggaatatgaagcgaatgagagcatacctcaacccgaccgttcaggcagcagctacagctctgccgctccggtatccacgctgcctgaaacctcagatcctgaaattatttcaaatggtgaaaaatccggagcagagcaggaaccgatcccggagttggaggttgttgttaaaagagagagcttgctgggaggcgtcgaaaaaacgatcacggatgaagcgcagatacggcaggtattaatgtttgtcgacgggatggtccgaagcgactacagcagcaatcctcctacgggcggggaaatcatcacggtgctgataacccgcaatcagtcaacggaggagtatacattctttgacaaccaggttgaaggcggcggcctggcgaaaaataatcaggatgccgatgtgaaaaatacctggtatcttgcggatgccggtgcttatacatatttaaacagcctgctctaaaaaattggtctgcgccgtccatgaaaacggcgtgtactgtcctgccggtatgcgccgcttgatttgggatggaaaaaatcaaacggcataaatggccgaatgcttgataaaacaagaccgggagaatataataggaacgttacaggaaaaaagaaccgctggatggaggaaggatcgatggacagcagggtcgaacgcttttacaatgggttgaagggtaagaaaatttcggtgatcggtatcggcgtgagccattccgacctgatcagccggctgcgcgattacggcgcgaaggtgacggcgcatgaccggcgcgcgcgcagcgcggtcggagaggcgatctgcaacaattttgaggcgcaggggatcgcgctgcgtctgggagaaaattatcttgaaaacatcgatgcggatattgtcctgcgcacgcccggtatgtattttcatcagccggtaatcgatgcgctgcggcgcgacggcgtcgttgtgacaagcgaaatggagctgttttttgatctctgtccgtgccggaccatcggtattacgggcagcgacggcaaaacgacgacgacgacgctgatcgctgagattttaaaggagggcggccgccgcgcacatatcggcggcaacattgggcgtcccctgatgccgattctgcgcgatatccgcgacaatgacttcgccgtcgcggagctgtcgagtttccagttgatttccatgcgtgaaagccccgacatcgcggttgtgacgaacatcagcccgaatcatctcgacgtgcatgggaacatgcaggagtatatcgacgccaagcgcaacattgtgctgcatcaaaacgcgttttcgcgcacagtgctcggcgttgacaacgaactggccgcatcctttgccgccgatgttcgcgggcgcttgtttgaattctccgtccggcgccctgtgcgcacaggcgctttcctcggcggggacggctttttgtacgcgtcggtcaacggcgaacggtcgaagatcatccacaaaaatgaactgcgcctgccggggatgcacaacatccagaactatctggcggccgtctgcgccgtgtggggcgcggtcgacgtcgaggccatccgcaatgtcgccatggaattcggcggcgtggagcaccgcattgagtttgtgcgcgaaaaggacggcgtgcgctggtacaacgattcgattgcgacgacgcctacgcgcacaatcgcggggcttgacagcttcggccagaagctgattgtgatagcgggcggatacgataaaaaggtgccgtttgatccgatggttcccaaggtcgttgaaaaggtgaaaacgctcgtcctcatcggcgcgacagccgacaaaatcgagacggcggtccgggcggacagtgggttttccgcctcggggatgacgattatccgcgccggcagccttgaggaggcggtcgaacaggcggctgtcgccgcgcacagcggcgatatcgtatcgctgtcgccggcgtgcgcaagctttgatatgttcccaaattatgagacgcgcggccgccgcttcaaggagcttgtgaacgcgctgtaatcacagcgaaaaaacaggaggacgctatgacgacaaatgaattgctgctgacgttaagcggtgcaatcggcgtgtcaggcgcggaaaacggcgcgcgggaaacggcgcgccgcctgctcgagccgcttggagcatgtgaaacaacagcgctcggctcgctgatctgccgcatgaagcccattccggagagcggggcgcatatgctgctgacggcgcatatggatagcatcggtatgatcgtgacgtttattgatgacaacggatttttgcgcgtagccggctgcggtggtgtggaccgcgcgaccttgcccgccgcgcaggtgacggttcacaccgcgtcgggcacgctgcccggcgtcgtctgtaccgtaccgccgcatctgacggatgacgacagcgtgctgccgaaagtcgacgagatcagtatcgacgttgggcttacggccgaggcggcgcgcgcccaaatcgcgcccggcgaccgtataacgtttgactgcgagccgtttgtgacgcccgcggggcttgtctgttcacgcgcgctcgacgaccgcgccggctgcgccgccgtaattttggcggcgcaaaagctggcacggcagccgcttgcgtgcggattgagcgtcgcgctgacggtgatggaggaggtcggcggacagggagcgcgcacagcagccagcctgttggcgccgacgcacgccgttgcggtcgatgtgtcgttcggtcacacgcccgacgcgccgcgccccaaatgcggcgttatgggggacgggccgatgatcggcgtgtcgccgattctcgatcacacgatgtttgaggggatgaaggcgtgtgcaaagcgccacagcatcgattttcaggtcgaggtgatgggcggcaacaccggcacggatgcagacggggtcgccgtggcgggcgtgggcgtgcggtgcgcgcttgtatcggttccgctgcggtacatgcatacgcccgccgaattgatcgacgcgcgcgatgtggaacagaccgccgcgctgatcgcggcatatgtgacggatgaatttgggggtgcgcgctgatgctgtatgagaatatcgaacgcctgagcgcgctgcccggcgtatccgggcgtgaggaggcggtgcgcgcggctttattggagctgcttgacggccgctgcgactgtaaggtggacgccctgggcaatctgctcgcttttaagcgcggcgcaaagaagccggcaaaccgcctgatgctttccgcacatatggatgaggtcgggctgatcgtcacctatattgaggacagcggccttctgcggtttgcggccgtcggcgggatagaccgccgtacagccgtcggcaagacggtgcgcatcggaaagacgcgcggcgtgatcggtacaaaggcgacgcatctgaaatcggccgaggagcgcggaaaagcggcggcgttcgatgcgctgtgcatcgatatcggcgcgaaaacgcgcggcgaggcagcggcgcttgtcagcccgggcgactgcgctgtctttgattcgcggtacgctttgttcggcgacggcttcctgcgcggccgcgcgctggacgaccgtgtgggctgtgcgctgcttgtggagctgctgttgtcggagcaattgccatacgatctgcacgccgccttcacggtccaggaggaaaccggcacgaccggcgcaaaaacagccgccgcacagatttgtcccgatattgcaattgcggttgagacgacgacagcctgcgatattccggggacgccgccggaaaagacggtctgttcgctgaaaaaaggccctgtgatttcctttatggaccggggaacaatttacgacgcggcgctgtacgcgcgcgcaatgcaggctgctgccgcttccgggattgcctgtcagccaaagcagggcgtattcggcggcaatgaggcgcgttcggtacagacagcgggcaacggcgcgcgtgtattggcggtgtccgtcccgtgcagatatctgcatacgccgtcatgtgttgccaaccgcttcgatattgacgagacgctgcgcctgctgcggcttttgattgatgtgtttggcgcgtgatccgctttgttacgccggagcttgaggcactgttttgtgaaaaatccgtacaatttggtatatttggagcaaaaatatactcacagtatcaaacatatggcgcacagagcggtatcctcgatatgtggctgttgtttgatgatacgtatgtaaccggctgcgtttcccggtttggcggcctgctgaccgctgcgtgcacgccgcgggcggatgtcgaggagctggcggtgttcctgcgcgctgtgggcggccgcgctgtggaggggatgctgccgctgatcgagagggtgcgcgccgtaacgcgcggcgaactttgttcgtcgcgcgtcatgcgggcagacagccgtggctgtctgcccgctcccgcgccttgcggcgcggacggcgcgccctgccccgcggaccgtctcgtcccggtctatgcgctgctttgtgctgccgaccccctgttcgcagccagggcggatgaagccggctggttgacggagctttctcataaaacacgccatgggttggcggagatttacatactaaaagtaaaaaatagtccgatatctacctcgggtatttattttaaaggtacagacagcgcgattctcgctggcgtggcgactgttccggccatgcgtgggcgcggttatggccgccgcctggtggagcatacaacagcggccgcgctggcacagggcttgacgccgtatttgttgacggcggacgaccggctcggcgcgttttatactgcctgtgggtttatggacgccggccagtgggcacggttggaatggtaaacggaaaggatagtcaaatttgatcgaacatttttttaagatcgatccgcgtttgctggatatcgcggacgctgcgcttggcgactgccgcgcgccatttgacaggatcgatgaaaccgcggaatacaatgcctgcaaggtgctggctgcttttattgacaaccgcgtaagtgaaagtcatttcacaggaaccaccggatatggatatggcgaccgcggccgcgacacgctcgacgctgtgctagcccagatcatgggaacagaggacgcattgatccgtcacaattttgtctccggcacacatgcgatcacaactgctttgtttggcgtgctgcggccgggcgaccggatggtgtcgctgaccggcgcgccgtatgatacgcttcagccggtcattggggttgtcccgggcgggcacggctccctcagggaatttgggatacagtacgaacagcttgacttatgtgcggacggcacgcccgattataaaaacgttgccaaagcgattcgtggcgctcgcgcggcatatatccagcggtcgcgcggctataccttgcgcgaatccctgcatatcgacgagatcagccgtttgattgatgcggtgcgtgcagccgacccggatacggttgtcattgttgacaattgctatggtgaattcgttgaaaagtgtgagccaacacaggccggcgctgatctaatcgtcggttctctgattaaaaatcctggcggcggcattgcaaagacgggcggttatattgccgggcgcgctgatctgatcgagctgtgcgcatgccggctgacagcgccgggcgtcggcaaggaggttggctgcacgctcggtgaattgcgcggaatgtatctgggactgttccatgcgcccaccgtgacagccgccgcgctgaaaacggccgtttttgcggcggcgctgtttgaacgccttggattcgcggtctatccgtcatacgacgcgccgcgtgccgatattatccaggcggtgcggcttgatacgcctgccggattggaggcattctgccggggcgtacagcgcggcgcgccggtcgatgcattcgtgacgcctgaagcatgggacatgcctggatatgacagccaggtaattatggcagccggagcgtttacaatgggcgcttctattgagctgtcagccgacggaccgatgcgcccgccatatgccgcctggatgcagggggggttaacctggccaagtggaaaaacaggcgtgctgctggccgctcaatcgcttctaaaggcaggacagatcgcgctgtaagcagcgtgcggcgctgcatggaacggttgacagactgcgtgcaggtatggtatcatatccgcagaacaaataggcctgccgtttgcgggcagatgccttcagacggcagagggcgtcatagccaaaccggccgcggccggtttgacgccgcgccttgcgcggcgcggcaagcccaccgggcttgccgctatggcgccgtccgcgtggcggctttttgtgcgggcgtggcggaatggcagacgcgctggtcttaggagccagtctttcggggtgtgggttcaagtcccaccgcccgcaccaagtggcaaggcctggagtcaatttatgctccaggcttttttaagaaagcgtccgtgtcctgcgcatagtgattttgagcaattgtgctaaagacgccagaagcaagtgcttctggcgtctttttcagtaaaaatgggacaatggcgcgccctatgattctgttttgttattctggctgaaaatcccctattgatttttgatacggcggggcagcgtgtcgatttgccccattttgaaagcctgcgtcaaaacacatgataccaactgttatcacacacatatgatctaattttattcaaatcacttgcaatatttgcaaatttatagtagactatacaaagtcaaattgtcgtgaagcagactgtggaccaaggcccgtattcaccggcgtgcgatatgatagaaaaagaaaagcccgctccgatcgagatgaatatgcgaaggagagcctgtatgctgtgaagaaattaacaaaagaaaagactttatctgaaaaagcatatgctgtgctgtgtgaaatgatcgcaaaaatgaagccgggtgaaaaccgtctgccttccgaagatgatctcgcccgactgatggggatcagccgggcgactgtgcgggaagcattgaaatatctgatcatcaatggtgtcacgactacgatccacgggaagggtacctttgcacacccatctgttttttcagtgcgtaaccgtatagacctttgtagtgattttatgttgatgctttctgagcaatatgacgacttaacagtcgacacagattggatggaaggcgcagcgcccagccagctttaccaggatgtctttggcgacagcgtgccgggtatgaccagcggttggacctacagggctgctggcaaggttatgttgtatgggtactttgaattctgttcggactatctggtgaaaagtgtgaaggcgggtaaaccatgtaccagtctgttgcagttcagccgtcagtatatgcaaaagcccatcgattattgcaccatgacggcccgcatgggctgtaatgccgcagcgaatgcggctttgcagttggatccagaccagatgcttctgcgttgggatgaaaaaatctacaatatcgatgacaatgtagttgcaaccggaaccatttatgtccatccgactaatatggagctatccgttgtgacccgctttgcagtctgagtatattaaacgaagacggcctttcaaaggatgagtttactcgattcaagtgggaccgcataaagaactgcgagttattttttcagattacaagtaaacggatgatcgagcctgtctgtaaatgcgatatctcgcctgcatccgttggactgcattgcctgatgaacgattatggccgaatcagtgtgttctatcaactgattcggctttttgttgtactttggcatagaaaaccgatctagtaccgcctgtggcggcatggtttgagaccaaagcttgcaggtcgggacgatccacatgcatgagaactttcatgcaccgctaataataaaaagcctcgtccatctttggacgaggcttcagacggtcaagaaaatccggcaggcacaattatacgctgctatgaaaatttatgcgtatccgatttgggtgatcgcggatccgtgtatgccagagcagacctgcagctttcagaagccgtcaggcgcccaaaattcatgaccgccggcttttttcgcttcgtccagctggcagaggttggcaagtccctcaaaaacgatgtcgattgcatgctcctgaccatcgccggctgtaaagccttcgcctgtaaagacgttgttatccacagatacgaccgctccgccgcggcggccaaacaggctgcacaaggttacgatggcagcggattcgcggtctgtgtagaggattcccgcacggttgtaatagtcaacaatgctcagatgctcatcctgaaagtagctgcctaccgagggatgtccagtttgcaggtattcgctgtcctgggaacgtccaattcctacttggtagcggtaattcagctcctgggcagccttgacaaagcaagccaccagctcatagctgcaaacggcaggatagctggatgtcacataggcactggtcatgccctcgtcccgtacaacgccgctggcgatggccacatcgccggaatgaagtttctcgctcaaggccatcccgccgcccagacgcagaaaggtgtttgccttgctgttctgcatgaattccaccaaaaccagctccgcctccggactgccgctgccgccgctgacaatgctgatatgggcgcccttatagcggccggaataggtggtaaacattccggagcggcctgccagaacccggttttccagccgctggctcaaaagctcggccggatccccgccatagtccagcaagggatcgcgcaccaccatgatgacgtaatctccgatcagcccaccatcgattttggtcagcgcaggctttccgtcaatcacaaagccgccgggagccaactgcgcggcatagggataccgcgccataatccgtttgaatttttcaagcaagaaaatgcctcccttccaacaatatcagtctatagccagagcgctgccgcgaatggtgggaagcccgtcctcacaatatacgccctggtgaccgtgcatatagacatcgccttcccgcaggggcatcaccgccgacagataagccatcaggcaagcgaacaccagagaaatcaaaggctctgaaacaggcttgcacaggcacagggactcaatgcctgtccagccttccagtacggcgggatcatcggtcatgaccaatacaggccgctccagcctttgcacgatcaaaagaatctccatagcgcgctggcggctgcggcctctggacgggatcagcagaaccgtgggcaactgcccggtatcgttgctgaagaaggtttggtgagcaaattcctccagatcctgagacagaacactgtagccctgtgcctccagcaccttagagacgccgaagtctgccgccccacggcttgggccggcggccagaaattccatgcgttcacacctgccgcagagggcggcaaaccggctcatgacctcagcaccggttttcatggctacccgaaggatatccgccagaccagccagctccgcacagacagcctggccttgtttttgagtcagaatcccgcggcgcaggccgagacgcacggccagcagatacaggccgatcaccggaggaacaaagctgcggatgccggggagggggattgaagcagcagagaacgcgggcgcttgcgccgtgaaaatgtactccactgcatggccgacgcatgaatccggattagccgtaacagccatggttaaaaaacccgctttccgcagattcatcgcggcttcagcgctgcggggcgcctcgccgctgctgctgacgcagatagtcagagtgcgggccgcctgctccggcagcgtgaacgccgccagataccgggatgcctccagtgccggcacagcgcaggcagacacatgggcatactcccgaaaagcctgtatcacgcagttggcggcattgagggagtcgccgctgccatagatatagacgctgtcgatctgatccagtactgtgtcgggcacggcggtctgtgctgtctgtgtcagaccgtcgaatatagcgtcgaacaggccgggatagctcaagacatgacgcaacatatcattctcattcattgtttacttctccttaaagctttacagcgtccagatttcggagccggttttccgcctttgcccgcagggcgctatcgagctttttcggcacgccccactggctgatgataaaagacgcggatacggctccgcatttggccgcataagcgatatcgccgccggatttgcagtaaccaaccagaaagccgccggtggaggaattgccgccgccggtcacgtccaccacatcggtgggaacgacggggattcgccagacagctccgtctccggctgccagagcgccttgagcgcccattcgcagaatcaccttgccggcgtgcatgtcctgaagctttttcagcacccgcaaaggctcggcttcgccagtgatccgccgtccctctgtcagattcagggagaacagatccaccagggacaagcggtcggcgatgcggtcccggttttcggcccgggctgccgaaccgtggatctcccagcaggagacaccgccatagccagccagatagcttgcggcttcctcccaatagtcctcgtcaagatccttgaagaaatacaggcccttgctgccggcgtaacggggcggcaggtgggaaaaccggggcagcatctcgtcatggctgccgcagtttggaagaagaatttcctcacgctcgccatcttcaaaatagcggatctgagcgtggacgcagtttttttcgcacagcacgcccgccacatcgatgtcattgtccaaaaaccaggtgctgtagcccttataatcaggtccgatcaggcagcagaagcccacttggtcatcccagatccgctgtcctgccaccgcgtagacaccgccgcccagttggccggattttccggcgccccagggaaaatagatgtcgtccacaatcatttgggttaatgttacatactggacctctttcatccgcctcctcctttctgtgtttggttgttagacgtaatacaaatatatcttatcaaatgctgcattgcctgtcaatgacggtttggcagaaaggattgtgttttgatcaaaaatattgcgattaatattgtgcagttcgccgatttttgccgtccttagccgcaatcgttttatttctcttgccatactattcaaaaaatgctaatatatacgtcgtacaacctaacagttcaagggagcgcgtgtgcatccaagggagcatgcacaaggcgacttttacggcgcagcccttggcgacaccatgcgcggtgcgcagattttgcccggccaaatggcgattaccgctatggtcaattcctttgaggaggcgttttaatgatgaaagaaccatatatcgccgcgatcggcaatgcctgctacgatgaatactacagcgcggactcgtgggtggagaacggagaaaaactgttgatccgtcccatggagaagcaagccggcggcatgatccccaacgccgccagcgtcatggcagcctatggcgtacacacctaccttattaactacatgaacgacggcgccggtaatcaggaattaaagcgggacctggccgccgccggcctggatgttactcacatcatcaccgacaaccgcctgcccgacgccaagtgcattatcgtcctgacgcctgcggagcgcactgttcttgtactggattttccccacccgccgcgggtgcttccaccgaaaacacaggagatcctgcgcaatgcagcgtatgtttacaccacaatggttgaaatgcgccggtttgaaaacgacctgcatcaagccgacgactggcggatacacggggcaaagctggtgttcgatgtggaggcgtcctcttttgagagtccgaacgaccccctctttgcccgtgcggatgtgctttgctttaataaaggaggtttcgaaaaatatgtcggtaaacgtgatgctgaagcctgcatccaaaatttgctcaaccggggatgcatcgtctccgtcacgctgggcgcagacggctgccagtgttgggatgcccggtcacatgtgcggctgcccggatggcgggtaaacgccatcgatacaacaggcgccggcgatactttcaacgcctccctcgtctgtgggcttttgcaagggaaaaccctaaaggcggccgcgcagtttgccaacgcagccgccgcccgtgccaccacggttcttggtccccgcggcggcgcggtcagcatggacacagttgaagcatttataaatcattgtcagaaaggaatggagcaacatggctgtttgtaaaccgattcccatcaagacctttgatttctccccttacggccgctactgggacctgcgcagggaacgcggcgtcaaagccgaaacctatgaggcttatatgactgtggatccgcctatggagcgcccccttcgctttggaatgactgtctgcgaaaacggcggtactttcccggtggacaccatggagcggcatctctccacggaagaaatcctctttgcaggcgacaagcccatcgtcctgagcattgccggcagtgatcccgccggtctgccgcaagcgaaggatgtggtttccctgctcatggagccgggagatctggtggttatgaagcggggcatctggcacgatgcctgccatgccgcagagggcacggcacaatactatttcctttcccacagcgacagcgaccctgatgaaacagcctggaaagctgtccagcctgcccctgtgcaggtcgcattgtgaaggaggcaaacagtatgaagcagatcaaagccaagcgtgcgaccccggaaagcttccgaaagtacggcgttgttacccgtttgactgacaatacatgctttcagggggaaggctggaagtgctggatgaccgacggcgactgtatggatcagccggcgcacttcggcatgacctatgtcaagacctatccgccctattccgtgaccgctatggaacgccataccaagaccagggaactgatggtctgcggcaatgaccgtcccattgtggtggcgctggccgcatccgaccctgccggccatgcacaggcagaggatgtagaggcgtttattctggaaccgggcgaaattctggtcatcgataagggcatctggcacgacgcctgtcgcgctctggattgcgccacccattactatttcttctctttggaaaccgacgaacccgctgtattccagcccctggacaatggtcctgtcgaaattgtgctgtaaagggagatttccatgcgtaccttactgatcaagaacatttctcaattggtgacttgcgatccgcaggaccgcatctgccaaaacgcggacctttactgtgaggacggcgtcatccgggcgatcggaacaaatttggacaaagaagccgatgaaattctggatggcagccatatgctctgctatccgggccttatcaacacccaccaccatctttatcagcagttttcccgcaacctgccccaggtacagaatatggagctgttcgattggctcaaaacgctgtatgagatttggaagaacctggacgccggtgtcgtccgcctgtcctccctgacaggtatgggcgagctgatgaagcacggctgcaccacttgtttcgaccatcactatgtgtttccaaacggcgcaggcgacctgatgggcgcccaattttctgccgcggaggagctgggcatccgaatgcatgcctcccggggcagcatggatctcagcgtcaaggacggcggcctgccccctgacagcgtagttcagactgtcgacgaaatcatggccgacagtatacggctcatcgagacttaccacgacgcttccttcggttccatgcggcaattggccctggccccctgctcccccttctccgtatcggccgacctgctgcggcaaagcgccattctggcccggcagtacggcgtgcggcttcatacacatctgtgcgaaaccctcgacgaggagcggtatatgctggaacgggaagggatgcgccctctggcctttatggaaaccctgggatggatcggctccgacgtatggtatgcccacggcatccatttcaatacggaagaactgcgcctcctagctcaaaccggcaccggcgtgtgccactgccccgtttccaacatgaagctctccagcggcgtcgcccgcatcccggagatgctggagcttggcgtgcctgtggggctgggggtggatggctccgcctccaacgacggttccagtctcatggaggagctgcgcttagcctatctgctccaccggctcacctccagtaaagcggcgccctccggctacgacgtcctgaagctggccacctccgggagcgcccggcttttgggacgcagcgacatcggctctctcgagacgggcaagtgcgccgacctgtttatgatcgactcccgccgcatagagctggtgggcgcctgccgcgacgccggttccgtattagctaccgtgggcgtccgcggccctgtggactacaccgtggtccacggtaaaatcaccgtccgcgacggccgtctcacaggcattgacgaggccgccctgtccgaagccgccaaccaaacatgcctcgcctatttggcggcccgctaaacgacgaaaaccgcgttgttgcgtgacgataaaagccccctgatgcgcctgcatcggggggcttttatcgtattgaaacgcctctgaaggcatgcggtcattcgaggccgttataccctcaggttatgcagcgtctttagccccagcagggccatgcgctcccggacgctgccgttcaggaatgccccttcgccggagcttgtgtcgtttccgatcccaagcagcgccccgccatgcataccgaacagacgtgtcatggtcagaacggttgtggtttcgatgtccacattggccgccccgatttttttccacaggtgcacccgatccaagaccgtctgatctatgacgccgcgggcggtttcaaagccgctgccagggtacatagtgccgacagacagggtcagcccctccttgaagggaatctccagactttcaaaggccgcaatctccgcctgaaccatatggcggctggggacggcgggatattctacggggacatagtccagcatcacccggtcctcccggatgccgccggagcagatcaccagatcgcctatcttcaggtcggggcgcataccgccggagttcccaacccgaaggatcgccctgacgccaagggcggccagctcgtcgatggctgtggagacggagaacgaaccgctgccgtggtacaaaaggcccaggcgctcgccttcaaacagcccgctgtacacggtatactccccgaactggcttaaaaccgctatatcatccatctgcttgagaaaatgttcaggctccatatccaggagcagagtaaaaatgaacttttccggcgtcccgtccctggcgaggcggagccaccagcttttcccatcctgtgggatagtagctttcaagggcggcaagggcatgaccatactcctttctcatttgcgggcgtcgttcagttctttgtcaaaagcatgaaagtaaccggcgagtttgtcctgcacatagcgaaacagcttctcgccagtttccagggtgctgcgtgaagcgccgccaagcaggccgctgccgggcgccaaatccctggtgagccagccgtagtaataatttttcaattcgacaaaaacgtcattttcaggacgaataaaatccgccttcactgtttggggcagggcatattgcaggtaagccgtttcgatctctccgccgtggatatcctgattgatggcagtttgcagaaggggctgggcgtcctgaaaaaaatcggaaccgaaataatcgatattgaacacccgaatgccaaatcgctgttcccattcctgggccatagcgtgaaacaccggcgcgtttccgccatgggaattgacgataaccaggtacttgacctgatgccgctgcatacacatcatcaaatcctccacaaaggcgagcatggtggcagttcgaagggtcacggtccctggaaaatccagatgctcaaagctgttgccgtagtgaagggtgggcagacgcagaaatgtgttttcggttttcagatgcttttccaatccatccagagaggtttggaggatcaggtcgtcagtgcccacaggcaggtgacggccatgctgctctgtggaaccgacgggcagcacataggccagccggctgcggtcaagggcgtccacctcgagccaggacatttgattgataggctttaacatagggcgcactccttcctgattgcagatgaacaagggggccgcagcccccttgttcatgttcagatattctcgtaatggcgtccgggctggggcgggaagaacaagtgctcggtaatgccggaaacgaacgccttttgaccgttaacatagcagaaacgggcggtgggacgtgaatcgtggccgcggtaggcgatgatccggccatccacaatgaccatggagttgccaaaagggtcgccggattcgatggctttcagggcgtcggcgccgcaggagccgggagggcagtcgatgacctggaggtcagcttcgcgtcccacttcgattttgccggtattcaggccgtacagatcggcggcgttgccggtggccatggcgatacacttgacggcgggaacatcgttcaggcaggaagcttttacgatggcgcgattgatggctccgggaagggacgcttggcccgtaggcgcgtccgagccgaaaaccatgcgattcagggcgttttttgcgtgcatatggcgcatcattttgttaaagttcacgaaatttccgttgacgaccagctcaagagcgatttcgctttcatccatcaggcgctcgatgtgggagaattccaccgcggtggagccgccgttggtatgggcgaccttattgggccgcagcttcataatgctctcagaggttacccaggaagatccagggatggagggcggcgccagatggacggaatagaaaaagctgtatttcctggcccactccagcatcggttccacttctgcgggatcggacaacccgccgccgccgatctcagcgatcagccatacgccggcgtcgtgcatttctttgaaatcctgttccgtcaggccatggaccagtaccagcgcgccgccgtggaccttcatggcgccgccgggacggaaatggtcgaaaacgcgttttgacatgatggcagcggccttgcagccgatggggtcgtcataaaagcggggccacccggggccttgttcgccttcggatataacggtggtggtaccgctgtagagagcgtcggcgtagcagcctacagcgccgcgctggggcgcgtagtcatcaagcgtgttatgtacatggcagtcgataaagccggggcagacgatctggccgtccacgtcgaccactgtctcgataccagaggcgtcgacctctttttcaaaaccaaaggcggcgattttaccgtcccgcaccacgatggtatcgccggggatgacgccgcgttcgatatcaccgctgacgatcttatcaatcgatttgatcactaagctattgttcaatgaaagctcctcctaaatgaatcagattgcaatagtcgccgcagactcagtataacacatacgtagtacgtcttacaagtggtcaacatgagttataaaaagattcgactggatgtctgaaaacagatgttgaattttggataatatatacaataacatatcattgcgatataaaaagataggaatattgccaaaatcaatcttgacatggaaaaaataatttgttatattataatcgcaatagtcgaacgtcgtatgacttattattaaataagcacagaaaactatgaaagggatttcttctgcggccgccaaatgcagccgcacagtcagaaatttaggaggaaaacagtatgaaaaaacggatcgccctgttgttggccgcgttgatgctcctggctattaccgcctgttccgctgaaaaacctgcctccgaatctcccttggcatcacaggagccggccggagaggtttcggctgaagaatccaccgcccagcccggggatcaggctctgaccatcggcctgtccatgtacaccctggagtaccccttttatgtcaccatgtgcgacgcctttgaggccgcctgtgaggaaaagggctggacctgcatcacaaccaacgcttccaccgacgcctccacccagttgaataactgcctggatcttctcaataaggacatcgacgctctggttctgacaagctggtacggcgacgcgctgtccgaggcattcatcgcagccaacgaaaagaatatccccatattcctgatggatacttccacactgcccgatgagggcgaatatgtcaccaggatcggcacggtcaattacgatggcggtatggtcggcggcatgtatgccggtcagtatctgctggagcagggtaggtctgaggtcgacgccgtcgcgctgcactccggcgatcaggtttccgtcgaccgccgtgacggtatcctggccggcctggaagcggccggtgtgagtgtgaatatgctcaatgaatatcacagcgcctcccgtgaagaatccatggccaattttgaggacgccatgacgacctatgccaaaatcgatctggtcgttgcgacttccgcccagcatggcatgggcgcctacagtgccgcggaagccgcaggaagaaccgaaatgctgatcgccgcctatgacggtgaagctgaggagatggaggccatcgacaatggtaccggcacctatttgtgcaccgtgacgcaggaccccgtcggtatgtccgaaaccattgcgcagcaggtggaagattatatcttcaacggcgcgacttatgaacaatttcagtccgctcctgccggcgtttacgggaaggatggccagctctccgccgccgatcttggtatcggctgatacaggcaatggaaaaaggctcctccagggagcctttttccatatcaagtatcccaataaaaaggagcgatctcatgaatgcgtcaaacaatgagaacattttggtattaaagggtgtcagcaaggaatttccgggcgtcaaggcactggataacgtcaatctggccgtccgcaggggcgaggtacttgcgctcgccggtgaaaacggcgccggaaaatccacgctaatgaagattctttccggatcctatactcgggacagcggcaccatcgaattctgcggccagcaggtggatattcagcagcccagagacgcggaaaagctgggtctttccatcatttatcaggagctgaacattttgcagggcctgacggttgcggaaaatatttttttgggacggcagccgcgcaagaacggactgataaattggaagaaaatgaaccaagccgccgaaatgctgttccggcggctgaatatccacctggatgtgcgccgaaaggttttggggatgagtatcgctgaacagcagttggtggagatcgccaaggccatcagcttcgatgcaaagattgtgattatggacgagccgacctcctctttgacagaacaggagacacaattgctgttccgcatcattcgcgacttgaaggcacaggacatttccatcatcttcatctcgcatcgccttgatgaaattttcaccatcgcggatcgaattacggtgctgcgtgacggctgcgtagtagatacaaaatcggtaaacgaaacctctaagccggagcttgtcgccctgatgatcggccgggaaatgaccaagcagttcccaccgcggaatgtacaaaaaggcgcggagcttctgcgcgtggagaacatcaccgacggcaaaagggtcaaggatgtgtctttctccgtagcacgcggcgaggtcttgggttttgccggccttgtgggcgctggccgtactgaaaccatgcgccttgtctttggcgcggataaggccagaggcggcacggtctatatcgaagaaaagcctgttaagatcaagtctcctcaggatgcggtcaggcataagatcgcatttctcacggaaaaccgaaagacggagggcctgatgatgaataaaccggtatatatgaacatcgtcacagtcgctctggataaggtgacaaggtatcgtctgatccggcacaagctggaatgcgcgtgcagcgagcaatatatcagggagctgaagattgcaacgccttcggtgtataagcatgtgtgctttctcagcggcggcaaccagcagaaggtcatcctggccaagtggctgatgtccgactcggagattgtgattttggatgaacctacacggggcatcgacgttggcgcaaagcgggagatctatgagttgatcaatcaactggcagcggcgggaaaagccgtcatagtcgtctcctccgatatggaggaggtgctcggaatcagcgaccgtatcgcggtgatgcatgagggccgcatcgcgggccttgtggagaaaaaagatttttcacagacaatcatttctgaatatgcaattggaggcgcggccctatgaacagcacaaaaaattcagccatgcaaacatgtaaagcttttttggataagctcggaatttgggcgatccttgtgcttttgtttctgtttttgtcagtcaccacaggtgatacctttctgacggcgtccaacctgatcaatttgattcggcagatatgcgtgaccggcgtgtgcgccatcggagcggcgattgtcgtatgcggcggtgagttggacttgagcagcggttctcttgccgctctggccggctgtgccagcgctatgctggcggtcaattttggctggcccacttggctggcttttgttgccgcgatcgccgggggcgcctgtattgacgccctgatcggctgtgtaatcgcttttctgcgggtccctgccttcatcgccacgcttggcatgatgtatgttctggacggatttaccctgctgatgaccaggggcacgcccatcacaaatcttccggattcgtataagtttgttggccgcggatatattggcccgattccctttatcgtggttatcctgttgatcctggtggccgtttttgcttttattttcaaatatacccagtttggacgaaatattgtttctgtaggtgaaaatgccacagcagcccacctttccggtatcaatgtccgtctgatcaaaatcgccagctttgcctgcgctggaattctaagctctctggctggtatcatgctcatggcccgtctggggtccggacagcccaccgccgcctctgatctctgcctgacggcgatggcagccgtatttgtgggcggtacctctgcgatcaacactcagggcgcggcgttcaagaccctggccggcgcgctgttcatcggcatgatcaacaacggcttaaatatgctggaaatcaacgcctattggcagaagatcgtgctgggtttcatcatcatttccgccattgcgctggatgtctaccggacacagcaggcgtcccgccggtcataactttcccgatttgagctgttttgcataaaaaaaggagcgattgtttttcatctgcaaatgaaaaacaatcgctccttttttttaggatctgtttaaaaaatcgaagcggccgcctttttgcgaaaacagcagcacgcggccggacgtttccatcaaatgacggctgttggcgccgggataaccggcagacgcccccgtttaaagagaaggggagaatacccggcggccccgcttaaatatgtaaaagaatcagggaaccgcatcatgttcaaacttattgagatctccccggtaatgcgagaaggcaaaatcaacaccagtatcattttctttcaccgctacattgtggaaatacagcatggacgcgtgcttggtagcgttgagcagggtaatatcctcgacggaggtagggttggcggatacgatggttctggtatttttgatcttggtggccgggttggaggacaacagatcatagagggagtgagccttaaaatcatagttcaaaatagaggcgcccagctcgtagggaataaaattccggattgtcaccaaggacgtatcgtcggcaaacttgcgccggaagatggggatgatcttctgatccttagccagccgcattttctccgccatatcctcagaaggtgtgatgacgctcagatccagaagttccgtccggggcgtttgtcccatccgctgaatctactggtgaaaaggctcataggaacagatggaattggagatgtcccggagagtggtgacgaaagtccccttgctggcctagcggatcagccatccctcctgaaccagctcggcgatggcctgacggacggtgggacggctgatctgatagtagctgaccagctcgttttccgtagggatagtgtccccaaccttgtagctgtggttttttatatcgctgagaataatattctttagctgaaaataaagggggaccggaatattgcgatccaggggttgtccccggcatttgagcagacggatattttattccccagcctggaagaggcgcgcaagatcaccggggaacgggagccggaacggattgcggaacatttccggagatttttcatgaagttttttataattaagttgggggcagacggctacctccatgcagccggcattgctgattgcagacgagcccaccaccgccattgacgccatcacccagtttgagattctggatgagctgctgcgcatcaagcggcagcatcagaccgccatggtgtttatttcccacgatctgaacgccatctcgcgcgtagcggatcggatcgcagtgctcaaccaaggccaggtggtagatcgaggaagttttcagcatattctccgccatgcaaatgatccctatacaaagctgctggtggaaaagcgggccgccgttatgagcaaataccgcactgtgttggaaggaagggggcttgcccgtgcttgaactgaaaaatatctgtgtcagcttccgcagggagcggcaggacaaaatttttgggcatacccgccagcaggtgcttttcgatgtatccctgcatgtgaaaagagggatctgccttggtattctgggggaatccggaagcgggaaatcgaccatgggccgcgttttgtgcggccttctgaggcctgacagcggagaagccatgctggacggcatatctgtttacggctcccgcgcggggcggcggaatctgcaaaataagctcagtgtcgtttttcaggattataccacctccgctaatccccgattccgggtcagggaaattattggagaagggctgaccgtccaggagcggcgggagggcggcaggctggatcgggacaaggagacggattccctcctgaaaatggtgggtctgtcgcctgactttgccggccggtttccccatgagctttcgggaggccaactgcaacgggtctgtatcgcccgggcagtggcctgtctcccggaggtgatcgtcttcgacgaagccatctcctccctggacgcccacacccaggtccaggtgatggacctgctgcgggagttgaaggacagactggggctgacctatatttttattacccacgatcttacctcgatcacctacctgtgtgacgacgtattatttttgtacaagggccatgtgacagaatatcttccggtcaaccgcatcagcgaagtaaaggatgattatgctcgccgtttgctggagtccatcgtggtatttgatacagaggaggagatggccggatgaccttctgcggagaaacgattttcccaggggaacgcaaaaagcttccccttcctgtgccgggaagcttaccgctggaagctgtgtgcctgtgcggagcttcgccgggccggaccttggcggtcactgccggggtccacggctgtgagtatgttggcattcaggctttgcgaactttggaaaaaatattggacccagccgctttggcggggaatgtagtccttgtgccgctggtcaatcccagcggattttacgccggagccaagcaggtcgtgccggaggacggcgtcaacctaaatcgtgtctttcccggaaatccagaggggagcttgacctttcggctggcctttgcgctggagcaggcgctctatcccatcgcggatctgctggcggacctgcacggcggagattgcaacgaagccctgtgcccgctggtgtttttccctgttacgggagcgcaggctgtcaatcgtgcatcccttgaggcggcaaagagtctgaccgtgccttaccgcattcgctccactgctcaaaacggactttatagctgggcggtgcaaaagggcgtcccggccctgctgcttgagcgtggcgggcagggggtgtggtcggaacaggaagtggcagcctgctgtgaggatatctattcgctcctgcggcacctggaaattctgcccggcgggaatccgccgcgggaacaggttgaaatcgtccaagctgtctacgaagaagcggctgcctctggattctggtatccggcggtgggcgtggacagatccgttaggatgggcgcggtcctgggatatttggaagatatgcaggggcgcgtggttcagcaggtgcgggctgagtttgacggcgtggttctctatcataccactgccttgggtgtccgtgccaaagatcctttaatcgcctatggccgtccgtaatacgttttggcaggtggcctggccggccgcggcggagggcctgcttctgatgctcctcagcgccaccgacctgctgatggtttcctccctgggaaccacagcggtggcggcggtgagtattttttctcagccgcgtatggtgatcctctgtgtgacgcgttctttttccgtggccctaagcgcctatgtggcacgtcggtggggggaacagccggactgtccgctgggtgactgcacccgtgcctcccttctgctggggagtgtgatctcttttctgcttttggccggcacctggatttggtctaccccccttctgcggctggctggcgcacaggatgactatctgccgctggccttgcaatatgcttaccccgcgctggcgagccttgccctctccggaccggccatcgtcctccacgggattctggcagggctgggggatacccgcagcgtcctttatgccaatgtcctcggcaacggcgtgaatgtgatctgtaacgggctgctcatctatggccttggcccctttccgcggctgggcgtctttggagcgggactggggacggccattggcgccgcagtcacgctggcttatacattggggctgttcctgaagcgggatcatccagcggccctgaacggccagggccgctggcggccggagagaacgtatctccagcttatgggtccattgaccgccggcgtctttctggaacaggcggcagagcgggtgggaatgttcgccttctcgcggctggtggcagatctgggcactgccgcgcttagtatccataatatatgcggaagcctgtgcgacatctattacagcttttctcaaggattgggaaaggccagtctggtccaatcgggacgggatttaggttctaaccagggtaaaaatttgcagcagctcgcagaggtatcccgatgggcggccgtgtggactggcggggcggcggccctgctctatttcctgctgcgtgcgccgctcctgcaattctatcatctttccgggaacaatctggaactgggctgccagatcatgctgtttgttgcggttgtcaacatccctgaagcatgggccatggtccatgcaggaatactcagaggcttgggccgcactggatttgtggccgcttactgcctggtcagcatcgctgttgtcaggcctatcctgacctttttgctggtccataggcttcaattggggctatatggagcatggatcgctttgacgctggatcaatccaccagagcggtgtgctccatgctgggcgtccggcggttgctcaaagcacagcccgcatctgaagcccttttgcaaaagtaaccgtacagcgtgcaggatgccgaacgggccggagaaaatctccggcccgttcgatgttgtcagttataagccgcaaagcgccttcgccgaaattcccgctggcccgttcatttccccgcagagcataagcgggtaaagatgtgcgccctatcgaatttcaaagccgccgcctacctggtaccgcaacgctgtcaactgggcgtccttgagggatgttcctttctttttcatctgggagatcacattataaattgcactagtgctgatgtattcctgatagatgacattggcttgctcgccaaaggctccttgttcaaacagtgtaaagagcgcgtgatgcaggggccagtaatccgcgagctgatttttataacatgtcacggccggctggttgccaacagcgatgtcgaccgtctcggaatatgtaacttcatcaaaggcgttttccgcgcagatttccggcaggaaggcatagcactccgccgccagtgtcggatcctccagagcttcttccagccgttggggcagagaatcgtacaattcctggttgtcgcaggcatgaaacagttccgcggctgttttcaccttatgcttgagccgctcccggccatcccagccaagatatgcgtccggcagggtggtttccgcctcctgcctaagaaagaaaaattgcttgtgcgaagcgaagccctccacgtcccattgctccaccaatccagccaccagggcgctgagttcctcgcttttgatatcatcgatgcggcattcgccggtcacatcgccgccggatttagcgccgtatatcttgacatagcacagcttctggttgccgagccgcttggcaatgtgttcgccaaggatgtcccagtaataggaaggtgcgccgagatttggcgaatcacccatgccaaccacatcgctgatgtaaacgcgccagcggtgagcattgccggcaaagctggtttcaagctcccgcgcctgttccccccgttccattaggccgacgccctgcataaatgaaaacagaaacgagccgcaggccatgccgagggcctgtttggggccggcgcccatgccgacagagcattcgaacagctctttgccccactgcggcgcaaagagataaaaattcagcacaatgctgttctctgtaatttgttcgatctgcggggtgatggtcagttcccagtcaggacaccagatatggtcgccctcgaccgaattttcacaccccaggcagccgtgaaggctgacccgcagcaggtagtcgagggtattgtgcacatccaacggatcgctttcatagcgggcggtgatctcccgggtctcaacagccgcatgacatgccgtcagcagctcgcggcaatcagcccaaaaggcctgcgtctccgggtcgtccgggacaaggttgagcaccctgcgcaaatgggggatcgcctcctcctcgcggtcgagataatatagcgcgtaacccatacgaaagtgccagttaggatcgtccgctccctctgcttcggtagaacgcagcaaagagacggccttctcaaacggatctgtttcgccggccgcgccggtatttgcataggcacgggccaacagacccgtcagctcatagctgcgctgctctgcagggatggcttcgatcgcgtcgatgatctgttgaaactgctcctgccggtgccaatgatccaattggtcgaaaaaagcctgatccatttttaacgctccttgttattcgatgacatcgatgacagttccatctctgtccatgatcctggtggggacaagctctacagtcagcggcatggccttcatactgtatgttcccgcgtgaggcgcaagaagcctgcacagctcctccaacgctttgcttgtcagcgtcagctccgggagctgctctgcgcatacaagcgcaggtttggagccgggacggatctgcacggccgtttcctgtccctgcaaaaaaagcgtccgctcctttccaacgcgcgccttgagcatacgtgccagcgtttcggcgtgcccggcgccaatgcgcagtgtcccacggccgtccgcccattccagatcaagctcatccatgtacagaaacgcagtggaggaaccgtcacgctccatcccgtcgcgccaggcgctataaaacgccggcgtttttaataaggagtcccggtcgagatcggcggcgcacatgggaagaaagcgcgccatcagcgccaggaatttttcaccattccagcacatcatggcgttcatctcgtcctcggtgatcgccgccgcctgtaaaaaagtaaaatggccgtttggcgtgtcaagctccccaagctccggatccatgcaaaagccgagcgctgtaagctgcgtatccgtttccagggcgattggtccgttgcagttgatatgatggccaagaccaaaggtattgccgctggagaacacataacgcgccaaattctgaagcaagctgaccggccagacgggcggcgcttcctccatgccgcgtttaagccgaaacgtcagctcaaacccataaccgctttcatcaggatcgccgctctccttttcatacagctcggtaaagccgtaggtaatataatgccagtgcgggacgccccgctcacttttccagatctccacgccgtccagtggatcaccgccgcctagggtgtaggggatgagcgtgccgtaataaacgccctcctgaccggggtataaggcccgcgccgcaccggagatagcgtcaaagcctgtttgcgccggctctgtgtgatttttcttgtccatactggcttcctcctgtcaatccgccgcgtcatagctgattttcagcgtcatgccgggcagagaaacgccttcgctgcatgtgatggtgtacttcttgtccgcggagaagccgatgatttctccgtcctgtaacattacatcgtattccggcacgtacgaaccaggctggccagaaaaccgcgcccctgttctgcccgccgtctgcgtgcaacgcctccatcccgcgcttaccgaacgcgcgcattccgcaggtgcagccgcataccccgttttccgtccggtaaagtccaaaccagatgcaaaggcaaaaaagcggggacggacgaagcctgtccccgcttttatcaaggcgattgctcctgaagcttgctcaggtaacgatagatactggtttcagttgttttcaaagccgcggccaattcggcgattgctcccttgaccaaaaaaatccccttttcatcgagcgtgcggacaacctccattttctcctgatagctcaggcgggtcggctcaacgccgaaacggtcaagttcctcctggatagtattggtgacaagcccctccaccgaaacctcaaagctgttatagaaggggacgccagtttccacctcatagggatggctgccggaaatcatcacattcaggatgtcccgaagctctacgagccgttcgacgttgacattgaccgtaatcataccctgaagcttcttttccgggttgtttctcaggaaaaaggtggctgatttcagcttgtgcttgctgcgtgaaacagcgcggtaatcaacgatgaattcctctttttcatagatgcgcgattccagaaaggtccgttccagggaacgcatttcgcttccggggaccatctcatcgtcaagcggattgagcacctgatagaccacgcgatcctctacgtcataaaggacaacctctgtatttgtaccaagtatttcagcaaaaaaacgcattaagggaagaatcgcgtccagatgttccttccgctccattgacggttcacctcagatttttatgtgggattttcactttttattatagtgtactaaaattatagaggattgtccagtatttgggcgaaatttaagcgcccggcgcagggccgggcgcccggattaaaatcggatgatgcctatgagctggagaaacatgaagaagatggcgacaggcgcaatataacggatggtaatggtgtaataccggttgattttcagcccttcgccgatattcgcctcgtccaaaagcgtccttggcttgagcacccagccgacaagcagtaccatgagcagcgcgcctaggggcaggagaattgccgagacaacggtatcgttgaaaaaatcgaagatggtttggcccataatcaaaacattggacagaggaccataggacatcatcatcacggaaccgatgacaaagacaattcctgtcacaatccagcaggagagcctgcggctcagatgaaactcgtccaccagatagcctacgattgcctccatgatgcagatcgtagaagtcaggcaggcaaaaaacatcatgataaaaaagacggtggcaaacaccatgccgaaattcatttgtgcgaagatcgcgggcagggtgatgaaaacaagcggcggccccatgcctgcttcaatattgaaggctgcggcagcagggaaaataatcagcccaaacaaaatcgccacaacggtgtcgccgaggacaaccatgagcgtgctgctgccgattgtctttttgcggtcgagataggagccgtaaacaaccagatttccgcatccaacgccgagcgcaaagaacgactgcccaatggcggccataaccgcctcgccgttgagactggagaaatcaggcaaaagatagaacttaacgccctctcccgctccaggcagcataattgcgcggattgcgagaaagatgataaacaaaaacatcagcggcagcaggatattgcagaccttttcaatgccgcccttgacgccgcgcaggacaaccactgtcgtaatcagcagcatgacggccagccagagcagcatctgccagggatttgtcgtaaagtcgctgaacaatgcgaccacctgatccgtcgccatgccgctgtatgcgccggtaacggatttgagcaggtaggccaccgtccagccggcgataccgcagtaaaaagacagggtaagcgtcagagcaattacgcccaggataccgactaagtaccacttctttccgggcagcagcttttttaatgcgcttgtatagcttgtgccggttttgcgcccgatggtgaattctgtgattaaaacagggaccgcgaccagaacaagcgccgccagatagactacaataaatgcggctccgccatggcggccgaccaggtaagggaatttccagatgatgcccaggccgatggccccgcccatcgacgccaatacaaaggaaatccggctgccgaattgttcgcgctgcccagcggccggtgtgttttcaggctttcccattgtcgtccctcctatccttatataaggatcacgaataccggcgcggcgtgggaataaaacagcaatcgagcttgcggcggtccgggcagaggcgccgcgtcacgtaagcccctgcttgacagatagagggatcgggcatataatagtcacttggaattcagagttccggcagcgaatgcagcgccggttttctgcccgttccgccgccggaaagtgccagctttccggcggtttttttgcgccaagccgtttgatggatgcatcgcggtattcatccaaacaaagcgggtaagctctttgttccggcaggtattctcggttctgtttcttttggcagccgcgccggggccgcatgccccggcgcgggtgagaggggggatttacagcagctcgaacccggcggtgaaatggcgcagggccaaaatgggaccctcatagaccagcttcatgcctttgtacgagtcgcggcgctgatagatatagtcgagtgcgtccacaatgcagtcaagatggttgtttgtgtagacgcggcgggatacgcagatacgcatggtttccagggaaggccagatcggttcgccggtgacaggatccttggaaccgaaggcgcaggcacccatttccacagcacggatgccggcttcctcaaagagagccacgaccagccgctgcgacgggaactcgtgctgcgggatatgcgggaagaagcggcggccatccacgtaaacgccgtgtccgccggtcggttccacaatggggattcccttttccttcaggcggtcgcccaggtatttgacctggttgatgcggtattccaggtaggattccgtacaggcctcctgcaagccgacggccagagcctccatgtcgcggccggacatgccgccgtaggtgataaagccctcatggacgatggccatctggttggcgtatgtaaagaattcatcattgcgggtgacaatcagtccgccgatgttcacaagaccgtctttcttggaactcatagtggcggtttcacagtaggagaacatctcccgggtgatctccttgatcggtttgttttcataaccaggttcacgcgtcttgataaagtaagcgttttcagccagacgggcgctgtcgagcacaaccgggatgtcatattttttggcaaattcactgacagcgcggatattggccatggaaaccggctgaccgccgttgttgttgcaggtgacggtgatgatgattacagagacggaatccttgccgtgctcgtcgacaatcctctgcatcttggcgatatcgatgttgcccttgaacggctccgccgcgctggaggcgtcaagtcccgcgtcgatcacgcagtcctgcggaatggcgccgatcaattcagcgttgccatggaaggtgtcaaaatgcatgttgcccagagcgtatttgccggacttcgcataatactgcgccataatataatcggcggcgcggccctgatgggtgggctgtacatgcggcataccaaacacatcgcgagcggaagcctccagcttgtaaaagctcttacagccggcatagctttcgtcgccgagcatcatggcggaccactgttcggaactcatggcggacgtgcctgaatcggtgaggcaatcgatgtacacgtcctccgctttcaggcggaaggcgttgtactgggcgcccttgagcgcctcgatgcgttcggcgcgggtgctctttttaatgggttcgacaaccttgatgcggaaaggttctgcatgctggaaattgggttccataaatctgacactcctttaaaaaaattaaccttgtgtatattttttattctttatgttaaaaataataacttaaaaataataaattgtcaattatgtaattataaatcaatttgtgtaataaatattatcaataatagacaaagcggaacattgttcagttgcacgccggcctgttaaaaacaaaacagccctccgaaccattcccggttcgaagggctgttttggctcatatacagcgttcagttatgacagtatgcgaaaaaagaaagcgggtgcgggcgactttagatcgtccgcaccccaaactcaaaacgcggcatgcttgatgtgccggatgatagagaggagtgtatttgggtatgtggcagacacatccgcatacagcgttatggagggctggcttcatgcttggccggggacgccgttggaaatggcaaaatggccaaacgcggtctgcataatacaacataatttccgttatgttgtactttgcctgctccgcaggactccgcaatcgtcattatactacatagcttgtcaaatagctgcctgtcatccgctaactctaaaagagcttggattttctcccgaatgttttcaaggggaactactttttcaacaccgtcgcataatctttctcctttcccgtatcgggggcgccccattttattccggtaagtctattgtaatacttgtattatatttcttcaagaggaatttctatccagacaatatgagaggagacacaaaagatgggatcaattattgtagcggttatattcattttcggatttccaattgctttctttattatattacggtcatatttacggttaaagaaaaaacttaaggaaatgtcagcgatttcggaggccgtatttgatattgacgcttatgcagccgcaaaacatacagaggctgatttctatgcggaaaataaacaagccgaagctgatcaagcattttctgcggcaagtgccaaaatagcgacccttgaaagaaagatagaagcgttaacccaacagcgtaaagaactgtcatccgaagtcaagtcacttgaacttgatgtccttttaggctctgttcgaatcgacaattatcaaaatatgaaatcagatgagatcaagaatgaactggttattttgcgcagtcagcaggatgctctcttaaaaaatggcgacgcggtcgaaattacaaatacagaatttcagaaaaagtttatcaatacacaaatcaagcaaattctccgctgcttcaacgcagagtgcgttggcatacttgggggcgtaaccgtaaaaaacgtggacgcttctcgcgccaaaattcagcaatccttttcggccatcaataaaatcttttcgtcagacggcgtgcaaatttctgattcgtatcttagtctgaaacttcaagagctaagtctgatctatgcttacatgctcaaagaggatgaagaaaaagagcagcgcaaagccatacgtgaacaaatggtcgaagaagaaaaggtgcggcgtgagatcgaacgcgaaaaagcaaaaatcgaaaaggaagaaactcaattcaataatgaagtaaagaaattaatgtcctacatgcaaaaatcacaggattcggccgaacgtcaactttatatcgataaaatcaatgaactgcaagaacggataaaacaattagaggttgataagaaaaatgtctttgatcgtgaacaaaatacacgagcaggctttgtttacattatctctaatattggttccttcggagatcaggcctacaaaatcggcatgactcgccggttggaacctatggacaggatttctgaattgagcagcgcatcagttccctttccctttgatgtccacgcgatgattttttctgatgatgcacctggccttgaaacagtcctgcatcaatattttgattccaagcgtatcaacaaagtcaatccacgaaaagaatttttccgggtcgatcttgaagaaataaaaaaagttgtacttaaaaatcacaatgctacagtaaggtttattgatattcctgatgcaattgaatacagagaaactctccgtcttgaggcccaggaaccagatcatgccgataggcacgatttggtaacagcataataaaaaatccgttcctgtcgggggcacaccggagacggtcaggcggaacaatccccccttttttttaggactgagtgaaatatttaagaaaactttgaaaaccaaaaattcccccgccagtgctgcaacactagcgggggatagcgaccaatcaatcacaaaaacggatgaagtgattatgaatgatttctccaggtcatttatattatatcacttcacgcccgattttacaagttaatggcggtgaagttgtgaaaaatccaaatcatttcgggacagtaacgaagctgtctggaaacagacgaaagccctacattgtgaaggaaggcctatccggcaggcaaaagcccataggctacgccgccacacgggaagaagggcttatgatgcttgctaattacaacaacgacccgtgggatatcgaaacagagaaaatcacttttcaggagctttatgagctgtggctcgaaaagcgggctgttaaattgggcgatgcaaacagggtttccctgaaagcggcatatatacactgttccaaactaaacaagctgagatacagacaaatcagatcataccaaatgcaggagtgcattgatagctgcggccgtggatactctacacaaggggcaattaaaaacctttttgggcatcttgaccgcttcgcaatggaacttgatattatatcaaagtgctattccgacctgcttacttccgagccaataccagaaacgagcaagaaaattttcacggatgaagaagtttcccggctttggaaaaatcaaaattttccgtgggctgattcaattctgttcttcctttacacaggtttcagaatttcagaaatgattgagctgcaagtttccgctgttgattttgatatgggcacgatgcaagggggaacaaaaacggcggcggggaaaaatagaatcgtccctattcattcgaaaatacagcacatagtccgaaaacgagccagacagtccaaaagcggctatctgtttgaatacaatgggaaaaagctgaaacaaacccactatagggctttgtgggctgaaatcatggagatgctagaaatgcaacacacaccacacgagtgccgccacacattcaggagccgccttgattcggccggggcaaacaaggtttgtattgaccgaatcatgggacataaatcgagagggacgggagagcgggtttacacccataaaaatattgaggaattgaaattgaatattgagctgattcagtaagcccttgaattttgtcaaatgctgtgctattctgtttgtggtgctaccgataaacggcaagcggttagttcccctgatctggtcaggggcgcttcttgccccctgatctttttagaaaggggggctgtcaaatggttacatattctgatctgattcagacaggtattttaatcgttggcattatttccctgttttttcaggcaaataaaaagaagtaaccgccaccctctaagcatgcggttacttctgtaatccagtagggggaaccaaccgtttgccggtagcaccctctttctatgtttagtataattcagggctgctggaaagtcaataggcttaattaatttaaatattatatccagttgaacattgaactagtaacaaattagtaacaaaataaggaacgaacccgctaaatatcaaggtttgccgcctttttgtttttattgtatcacatttttctcaggcaatccactgcttttgagggcatagtcgccggccttatcaagcagaccgcggtgatcgcctgaaatttccgtgaacgactgcggtacatctccgacaattacagtttccgccacgcatacctctgtggacacaactgtatccacagtatacgtcggcatgacggcgctcaccggcacctccacacgcagcatgatctgatgcagcgtttggttgatacccgcttcctgaaacgcattatagaaatccgtttttgcatatccctgcggaatgacccggaacgtcacgtccggcccgcgtcccgaaaggaactgtcctccaagcaatgtgccgatcggtatttggacgccgctttgcgcatccaaattcaaacggtcggacacggcgtttgtaatctccgctttcaggcggtttacagccgtcatatccgtttcaagaaaagtaacgcgcccctgtgcgtcctcgcgcacatggataatcgactggtagtcaacaccgccgcgtccgatcacgtcgagcaccgcgtcattgacggagcgcgtcgcggctaactgcgcctgataagtaaagacagaggtaatcgccggccgcacacgtccgcccaataatagcgcgcctgccaaaatcgccgcccccgtcagcagcatcttccatgcgcgcagtttacgtttgctgacacggattgtaatcggcacgggcgccgcccccttccatcgcttgcatataaataaatgtatgtctgacaggcttaaaatgtgcgtaaacaaaaaaatgcggccgttttcaccatgaaaacggccgcattttttatagattgcgcagctatttattatttttaaaatggaccggcttatcaaaatacatgtatacctggcatttaatcataccgttatacagcttgcggcggcgcgcggcaggacgcccaaacagatcctcaaagccgtcatccgggctgatgatgtaatagctgaagccgtcacgcttcggaaaggaagcgccaagcgtacgagacaacgcctgcgcctcctgttcgccgagcatacgctctccatacggcgggttagccagtacaataccgcttcgtccctcagggagctgcggcgcaaaatccgcgacatcggcctgtacgacatgaatccgcccggccacgccggcttttgccgcattttcacgcgtcaggcgcactgcctccggatcgatatcggaggcgaatgcctcaaagggcgcgtcgcgccgtacctgggaggccgcgtcgcgccgcgcctcatcgaacagcccgttttgaaagcaccgccacccctgcgcggcaaaacgccgccggatccccggcgcgatattgagcgcacgcagcgccgattcaatcacgagcgtcccggaaccgcacattgggtcaaatacaagcgaatcgccccgcacgcgcgcaagatcgacaatgcctgccgcaagcgtctctttaatcggcgcatcgttcgcattggcgcgataaccgcgtttatgcaggcccggaccacttgtgtcaagcaaaagcgtcacctggtccttatggattgaatattgaatttggtagagcgcgcctgtttccgcaaacaatgttttgtggtatacgttttcaaagcgccggacaacagcgcgtttgatgatcctctgacagtccgacatgctgaaaagcttcgaattgactgaccagcctttgacgggaaagcaatcgtcctccccaataaactgctcccagggcagctcagcggtctggtcaaacagctcagtgaatgtctccgcccgaaagctccctatcacaattccgacgcgctcggctgtgcgcagccagatattggcctttgcaaccatcgaaagatccccgtcaaaggtaacacggccatctgtcaccacaatattctctccgcccaacttcttgacctcaaacgacaatacgctttccaagccaaacaggcagggacacatcagcgttactttttccatcatcagcctgtcctctcctccggcgcgctgtgccgctgagcggcacagcttccggcgcctgatcatccgctccaaagagagaacgaacaggcgctcatagccgtatttttatccatcatagcacagttttcctgcaaatccaagcatccgtctcacagtcgcagcttttcaccaaatacggcggcactctgcataaccgcagcgcgtacagcttcggatacagggcggtttggatccgggcgtacctcgcagtaaaagtccgcattttttcccgtcaggcagacaaggctattggccgcggtctgcgcgggcgtaccacctcccggaaatgacacggccatcagccgttccattcccgccatcttcagcgggaacaacgggctgccgtagcaagcggaaaaatcacacaggcgcattccctccaaagcgacgggttcagcatctccccacggacagagcgcggccaaaagcgcagcccgttcatttcccacaagcggcagaaccttaagattccacgcattggaatgtagtgaatctgaataaataacagtcacgccggtcgacacatctacacagttgaccgcaaaatcacaaactgccggacgatctaacaaccccgctttttcaagttgacgcagccctgtttgcggcgaaacactgcaaaacagatgcatctgtttatctatttcctccaaaggtaccccgcgcgaccagagcaacgatggtactgccgccagtgaagtcgctgacagcatcgtgatttctatagaacgcttttgcaggagtgcggcaaattgatgcgcggccgccgcgcacgcaccgctccctgaaaatgcgacgccgattttcatggcggacctccttgggccatgccgtacatccggccaaaccgtacgcagcagccccattcatcagactgtccgccggacggctttgaatctgtttcgcatcctgactcttggaatttttcaatgtgaagatttgtcgcggaagatacaaagcagactcctgaacaggcccggcggatattaccatcgtatgccgcagcttcgtcctttgaccatcagcgcggagccggccggccatataccgccataagcgcaagcgccgcgcgcaggccatccacggctgcgctcataatgccgcccgcatatccggcgccctcgccgcatgggatcactcccgccgcattgggcgcataaaaatccataccgcgcggtatacgtaccggcgacgaggtacgcgtctccacacccgtcagaagcgtatccgcggcgtcaaaccctggcaatttgcggccaaaggtccgcaggcccgttttgagcatctctgttacaaaaccaggaaacagggcgccgaaatcgcagccacagacgccgcgcgcatacgtcggttccacacggccgatgtgaagtcccgtctttccttccagaaagctctttgcatcctgcgccggcgcgccgtatccacggccgcccgccgtaaaggcgcgccgctcaagctcctgctgaaagcgcataccatcgagtggagccgtaccaaaatcatccggcgtcacggagacggccaatgcagcgttcgcatttgttccatcgcgcgcaaaatcactcatcccatttgtaacaaccatcccttcctgtgaagcggccggtacaaccactccgccgggacacatacaaaacgtatatacgccgcgtccctcgcctgtacggtatgacaactggtactcgccgaccggcaatgccgggtggcccgcatatttgccgtacaggccgcggtcgatctcactttgcagatgttcgacgcgcacgccaacagaaaacggtttgggctgtaataccaatccgcgccgcaaaagcatttcaaatgtatcgcgcgcgctgtgtcccgccgccaggatcaaaacgtcggctggaacatccccctgcgttgtccggacggcgcacaggcggccgttttcgagtatcaaatcggatgccggcatgtaaaaacggacttctccgccgagtgattcgatctcggcgcgcagtctttttacgacgctgcgcaggcggtccgtcccgatgtgcggcttggccctgtgaaggatctcctccggcgcgccgaagcggacaaattcccggagcacccacgcgcacttcggatcgccgatccgggtcgtcagcttaccatctgaaaaggtgccggcgccgccctcgccaaactgtacgtttgtttcaggatcaagcgaaccgccgctccaaaaccgttccacactggcaacgcggctgtccatatctccgccgcgttccaaaatcagcggcgcgtatccgtttttcgcaagcagaagcccggcgaacatacccgccggcccaaagcctgcgatcactggccggtgactgagttttcccggtccgaacgccgcttccagaggttcctccacgcgcagaacaaccttttttcccttagcctgcgcccgctccgccacacgcgcttccccatccgcgagcgtcaccgagacggaatgtacaaaccgaatatcgccgcgccggcgcgcgtcaagcgatgtctttgcgatatatgcgctctgaacaagcggctcagggacttccagtatgccgactgcctttcggatggcttcctgccggtcctctgtcagagaggtgatgatcgaattgacgatgatcgccatattttcctccttttgaagcacaagggcgcccggaaagccgggcgccccgcgttttatttttccgtcacagtcacaatcgccttatattcgccggttgcccagacaagtcctttgccgggcgccgagatacgaaccggcatctccagatacgtgccgggcgaaacctcctttgaggtcatatcaatctccgccaccaagtctgtgtttgtcaacgcagccatatcatccgggtcgccgaccatatgcacattgggaatgcttgttgactggatggttaccttgtaattgatcggtacatttgtcgatttgatattttcagccgggattgtaaaattggcttccagcatcccgtccgtcaaaatctcaacccataccgtatcgactcccgaaagattgcggaaaccgcgcgggagaattccgtcgtttccgtcaagcgggaatgggaacagatgattatcaggcgtgatctcgctgaggttgataaaaccaaggtccagcacatcgtaggaatctatcagcgtttcggggccggccaccagaacgcttgcgacagaataccgctcctcaagccggtcaattgggaaatcgcgcggcgtgttaatgtactcatagttgagcggaagctccttctttttatagaccggcaccgtaatgtccgccgtctcgacgccaagggtcagatgctcctttgaaatctcattaccctctgcgtcatatagcatgatctcacttgtaaccgtcttgctggatgtcagcggctcagaaaatgaagcggaaaccacgcatcgatcaatgcggttgatatcggcttccgggccgctgattgtaacctccttggggctgacaagcggttcatcacggtaatattcctccggggaggacaggccatcgatatcagtaacaatctggaacgtttcgcgcgcctcccggtcgacacggatacgtactgttccagggctgattgcatcgcttccgtcaagctcgaatccctttccatagcggtcgccccgattgtaattgctcgtcacgccgccaacaagcgccacatcatacgtccctggcgctgtaatgccggaaagatttgcgacgatatcgatatcggacgcagctacggaactgagtacaaggcgttcagcccggattttgacatcaacagtcgcagtctcgttgtcaacaacaaacaaccccatcgaattgagcacatcactgtcgtcctgagaaacggaaaccggaacatcgtgtacagttttgcgtgaaatcggcgatacataaataacgattacaagccaaatcgccactgcaagcacaagcgacaacaacttcatcagatttttattgtcaagcaaacggccaaaattaatcttcatgcttctcatcctcctgtgcgctgctcgcctttttggggatgaggcgatccaacaaccgttcggactgatccggagtcttttccggcgtcaattccgccgtcaaatattcccgcagacgctccaaagacaggccgcgatcaagccggccgttgcgacaaatcgtaataaaccctgtttcctctgaaacaacgacgacaatcgcatcgctcatttcgctcatgccgagcgccgcacgatgacgcgtaccaagctcccggctgatctcctgattatcggaaagcggtaaaaaacatccggctgcatgcagtcggccatcgcgaacgatcatggcgccgtcgtgcagcggcgaattggggaaaaagacatttccgatcagttccgcagacggatcggaatcgatgatcgttcctgttttaataatatcgccgagcttcgttttctgctcaatgactacaagcgcaccgatcttctggcgcgatagcgaagccgcctcaccaacaagcgcgtctataaattttgtccattttgcgcgttcctcctgttcgttgacgctggatgaaaaaacctgtaattttccaatacgtgaacggccaacctgctcaagcgcgcggcgcagctccggctgaaacacgatgacaagggcaagcacaccgatctgcaagatattctgtgtaatgaactgcatcgcacgcatctctagtacttccgacagcaaatataggacaagcagcagcgcgatccctttgacaagctgggcagcgcgcgtctcacggacaagcttgatgccctgatagatcaaaaatgtcatgatcaggatgtccaacacatcacgccagttgatcgtgctgaacgtctccgcgatattgtaccaaagctcggccatacgttcatttcctttctgctgttccaaacatgcggccgcatgtttccttatatattttatcatgccgtactgcggacataataaaactggccgtcaggacggcagcgggccgcgcccgcgcttcgccccggccataaaggattaaatagatgtcctgcgtttattttatcatgtccgcgccgcggcatgataaaattggccgtcagggcggcagcgggccgcgcccgcgtatcgccccggccataaaggataaaataaacgccctgcgtttattttatcacatatccgcagtaaatcaatctttttttggcagccatattttctctattgggccgccacaatccggcgaacagcttcggaaaaggccgcgccctgttccaccgtgttaaacgcgccgatactcaagcgcgccgttccgccttcgattgttccatattttttatgcgcatctggcgcacagtgcagtccgccgcgtagagcaaagccagctgaattgagcttggcggttgtctcctctgacgacaaaccatcgatattaaagcttaacacagccgaactggttccatactgcggcgcaggtgtgtaaagctttacgcctttaatttcctttaactcatcatagatacagcgtgtgatgtaaagctcgccgcgagcaatccgttccatcccgcatgatgaaacaaaatcgatgccagcgccaagccccaggattccgaccgtgttcagcgtacctgattcgaagcgatccggcataaaatccggctggtcataatcaaaggatgcgctgccggttcctccctcggcgagcggcagaagccgttttccataggatgttattaaaaatccggttccagacggtccatacagccccttatgacccgctgcacagagaaaatcaatccccatcttctgcatatcaatcggttctgttcctgctgtctgggctgcgtcaacaaccagatacaacccatattgacgagccaactgcgcaagctgtgtgatgggcaaaattgttccgaacacattcgaagcatgcgttacaatgatcgcgcgtgtgttggggcggatcagagagcgaaaggacgctacggtctgatcgctgtcaaaagaaacgcacgccgaactataagtgattataccgcgtgttgcaagcgtatgcacagggcgcagcacggaattatgctcaagatcggaaataattacatggtcgccaaagcgcagaagccctttgatcactgtattgagcgcataggtacaattctgtgtgaacaccacgtcctcaacgtccttcgcgccgaaaaaacctgcgatcttggagcgcacttcaaatacctgctttgccgtttcaaccgaaaggtcatgtcctccgcgtcccggattcgcaccataacgtgtcaatgcagtatcaacagcattctttacgacaagcggttttggaaaggtcgtagcggcattatcaaaataaatcattggggcttccccctttttatttcggagattttcacccctgccgcctccaggatggaaaccgcacgcgatacatccccctgcactcgcaggccatatccgcagccttcacggctgtttgggaacggattgcgctccacatatgccgaaattccgttgctttccaaaagcttctggcccttcattgcataggtgatcgagcgtacaaccaaaatggaattttctattgccattaaaagctctcccaacataacaaaatacagcggcatggcagacataccgctgtatcatcttatgcaggcacgcacaaggtggtcatccgctccgttccagcaggcagacagcgtgcgcacggatcccctcctcacgacctgtaaagcccatatgctcctcagtcgtcgccttcacgctgacgtcctccggccgcgctccacaggctttggcgatacgtgcacgcatctgttctatgtaaggcttgatttttggcgcctgtgcaataactgtcgcgtcaatattgccaacgcgccatccttgcgcacttattaaatctgccacacgcacaagcagggcaaccgaatcagcacctgcatacgcgggatcactgtccggaaataagcttccaatatcaccgagcgccagcgcaccaagcaatgcgtccatcacggcatgcgtcagtacgtccgcgtctgaatgaccatctaacccgcgtgtatgcggaatttcaatcccaccaatgatcagtctgcggttatctgcaaacctgtgcgcatcataaccatgtccaatgcgcagcttcatgcctccatctcctcccgcagctttgcaatcgcctgcgcagccaaaagatccaccggcgtcgtgattttaatgttatcgctgtccccacgtgacaagtgtactggaaatccggccgcttcaagcatctggcaatcgtctgtataatcgtgtccgctttgcaatgcggcctgcgccgccgtgcggtaacgttccagttcgaatacctgaggcgtttgaaccgcgaaaagacggctgcgatccggggtcgattcaatcataccgtttgcatccgccaccttgatcgtatcgctgaccggaacagcaggcgccgctgcgccatatcggatggcgtcgaacacagcgtcagcgatcacctgcccacatacaaacggacgtgcgccgtcgtgaaccgccacataccttgcctgcggcccgaccgcttcgacgccaagttgaaccgactgttgacgcgtttgcccgccggcgataacagaacggattttcggcacgccccatgcacgcgccagagcaagcatgtccggtattgtgccgcgccgtgtgacaagcacgatctcatcaatccaatcgctgtctgaaagagcgagcagcgtccgcacgatcaccggtatgccgccaacttcctccaattgtttgtcaagcccctgcatacgcgacgacgtcccggctgcaacaaccacagccgcaacatatggccttttcacatcgatctcaccggtttgctcttgaccgccttttctccaaagcagcataagcttcttcctccttcccgttttggcgtcccgcagcatgaacgcaaactgcttaataacaagtccatgtagctcccgattgaaacataacgctttgcggatatgatttaatcgctttcagcgggccgcgcccgcgtatcgccctgaccataagggataaaataaatgcctttgcatttattttatcatgtccattccgtgaaaaaatgctgtatcatggagattttatctcccaaaggataaaaataatcgtgcatttcaagcagaaaaacacccccgctgtgaagcgggggctgcataaagcgcaatcaaatcgaaattgcatccgcaatatcatacagatgacggtcaaactgctttttcatctggagagcttcaagaatatcataatcgacaattttattgtcatgattgacaaccacacggttgccgatcccctgttcaagcaattcgacggcgtgataccccatctcgctggccagcacgcgctcccgcgcggacggcgcgccgccgcgctgtacatggcccagtacggtcgcacgtgattcaacacctgtacgcgcctcaatttcctcggcaatatcatgcaccgtaccgactccgccgacactggttacaccttcggctacgataataataaaatgctttttaccggtgcgcagggttcgctgcattttttcgatgattgaatcgattgagaacggtacctccggcaccaggattgcaaccgcgccgcatgcgataccggcatgaagcgcgatgtcgccgcagcggcgccccatcacctcgacgattgagcaacggtcatgtgactgagaggtgtcgcgcagcttatcaaccatgtccataaccgtattgaccgccgtatcaaagccgaccgtataatcgctcgaagcaatatcgttgtcgattgtgcccggaataccgatacaaggaatccctttcaaagataaatcccgcgcgccgcggaacgagccgtcgccgccaatgacaaccaagccgtcaattcccatctcgaggcagacctctttgccgcgttcgacacccttatcgtcgcgaaattccggacaacgcgccgaatacaggattgtaccgccgcggtgcagcgtatcactgacgctgcgcagattcatttcaaacatatcgcgcgccagcaggccgctgtacccgcggcggattccaagcacgcgtatgttccggttcagagcagttctgacgacagaacggatcgccgcattcatgccgggggcatcgccgccgctgctgagtacaccgattgttttctgtttaaactccatatcgctgcatcctccgtctgggggaatcccccgcatttctatagttcaacgtttctcattatagaggattccccgcgtcagttcaagcaattttatataatcgcatgcaaatttttcattttagagaataattttgtagacatatgggaatttttcatctatcccgcccaaggtatttcctttacgcacggtaaacgacattctcctcgccaagcagttttttcagctcgcgctccaggacggggttccagaaaacgcatagcgtccgggaagctacattatatgttttagtatccataaagtaaaaataaacggtatcgcatggttccaagctgcgctccggcgcaaagatggaaagcagatttttaacacgcgcaaacacaggtgcgccgctgctctcaacacgaagatagacgccggcgttcttacttggttttgtgctgggcgcctgtgcctgcacgcgcgcgccgccccgtcctaaagcgggcggctcctctcccggaagggacgcgccctcacagatgagtttcgcttcctcctcctcgcgcactgagacgcgcgccgcgacaagcacgacacttccttccacgagcttctgcgagcactgcgccagcacctttggaaacaccagcatttccatactgccgctcgtatcctccaagcgtacaaacgccatcatctcaccgccgcgcgtcgatttaagccggcggctgtttacgatcgcggctacccgcacctgtgtgccgtcagccacaccgctgccgcgctcctccgccgaagtgatgtcggcgatcagcgtacaattgttttttgacaccatctcctgaaaacgtgccatcggatgaccgctgatataaagccctgtcgtctccttctccatcgccagaagcttcgacggctccagctcctccacgtttggaaggatatgaattggcttagaagcgcctgccgccgtatcaaacagattgatttggccggctatatttcgtttctgcgcagagtcaatatcgtccagaattgcctcgtaacctgacaacatctggttgcgatttttacatacgcaatcaagcgcgcccgatttgatgagactttcaacagcgcgcttattcatatcttttccatacatacgttcacagaaatcggaaaagttttggaatactcccccgctttcgcgctcggcgatcaattcacggataaagccgcggcctatatttttgaccgccagcaggccaaaccggatttcttcaccgctgactgtgaagccctcgacgctgacattcacatcagggggaagcaccttaattcccatgcgattacattcgccgatgtattcaatcaccttgtcagtattgtcaagcacgcttgtcagaagcgccgccataaattcgcgcggatagtggcacttgaggtatgccgtctggtaggaaacaaacgcataagccgccgcgtgcgatttattgaacgcgtaggacgcaaacgaactcatctcgtcaaaaatctgattggctgtctcgcgcgccacaccgttttgctgcgcgccggcgacaaacgcttcgcgctccttctccatcacgtcgtgttttttcttagacatggcgcggcgtaccaaatcggcgcgtccatacgaatagccgccgagcgcccggcagatctgcatgacctgttcctgatagacgatacaaccgtatgtgacatccaggatcggcttgagcagcgggtgcttataggtgacaagttccgggttgtggcggtttcggatgtaggtcggaatcgattccattggaccgggccggtaaagcgaaatgacggcgatcaaatcttcgatggaggtggggccaagctgtgcgatgacggcgcgcattcccgcagattcgaactggaacaccccaacgcactgtccctttgtcagcatggcgaaggtttccggatcgtcgagcggcaccgcgtccgcagagaatccgggatgtgttttggccgcctctttttcggcgtagctgatgaccgtcagcgtgcgcaggccgagaaaatccattttgagcagtccaagctcctcaagcgtcgtcattgtaaactgtgtgacaggcatcgtttcctccgccttataaagcggcacgtagctgtccaccggatcgcgggtgattacgacgccggccgcgtgtgtcgacgcgtggcgcggcatcccctcgatcttgcgcgccatatcaagcagttccgcaacccgcttgtcctcagcgcacatcgtcttgagatcggcggaaacagcgagcgccttatccagcgtcatcttcaattcattcggcacaagctttgcaattgagtcgacctgctgatacgacatgccaagaacacgccccacatcgcggattgcgccgcgtgcggccattgtgccgaaggtgatgatctgcgccacatggtcggcgccgtatttgcgcaccacatagtcgatcacctcctgcctgcgttcataacagaagtcgatatcaaaatcaggcatactgatgcgttccggattgagaaagcgttcaaacagcaggctgtagcgcagaggatcgatgcctgtgatgccgatacagtacgccgcaaggcttcctgcgccggagccgcgcccaggtccaaccgggatgccaaccgattttgcgtaattgataaaatcggaaacaatcagataataatcgacataccccatctttgtgatgatattcagctcatattccagacgctcggtaacgctccggtccggctgttccccgtagcggcggcgcagcccctcggcgcacagccgcctgaaatacgcctgattgtcctcgccatttggcgcgacaaacagcgggagttttgtattgccaaattcaaattcaacattgcactgttcagcgatcttcagcgtgttgtcaagcgcgcccggataatttccgaacagctcgtccatctcatcgcggcttttaatataaaattcctctgtttcaaactcaagatcaccgggcgcgtcaacagtcgtgttcgtctggatacagatcaaaacgctctgcatcctcgcgtcggccttttcaatataatgcgcgtcgttcgtcgcgacaagcccaacgccgatttccccagccagacgcaccaaatccggaaggatctgctgctgtagccggatgccatggttttgaatttcaatgtaatagttgtcagcgccgaacagatcacgataccaaaccgccgtttccttcgcacacgcataatcgccctgcgcaagcatccgcgggatctcgcctgccagacaggccgacagacagatcaatccctcgtgatactgttcaagcagtgcgcggtcgatgcgcggcttagagtaaaagccctccacaaaaccggctgacaccatcttaatcaggttttgataaccagtttcatttttgcacagcaaaatcaggtgatacggcgacgtatcgatcttatgctgcttatcaaaacgagagcgcggcgcgacatagacctcgcatccgatgattggcttgacgccgtgctttttcgcacatttatagaaatcgacagcgccaaacatcacgccatggtccgtaatggccacggcgctctgtccaagcgccttaacacgctcgatcagccgttcgatgcggcacgcgccgtcaagcaggctgtattccgtatgcacgtgcagatgtgcaaaatctgtcataaccgcacatagacccccttttcctatcattcattattcaattcgtacagccgtccccgacgctgttaccatcagcatcccgttatttgaaccgagcgtctcatagtcgatatcaatcccgacaacagcatccgcgccgagtgcggcggcccggtcggacagctctttcagcgccgtttggcgcgcctgcataagctcctgctcataggtgttcgaacggccgccgaaaaagttgctcagtccggccgtgaaatcctttacaaaatcgacgcctgcgatcacctcgccgaatacgacgcctttatattctgtaatgcgcctgccttcaataaacggcgttgttgtcataatcattgattcattctcctccagttgccttcccaagctcctgcgcgaacatgaggatacggcgcaggcggtgattgacgccgctgcgcgaaatcggggtctgcaaagcttgtccaagctcccttagcgacagatcaggattttccaggcgcagacgcgcaagctcgcgcagatcctcgtcgagcgcctgaatgccgcagctggattcaatcagccggatcgcggcgatctgttcaagcgccgcctcaacagtctttgtaatgtttgccgtctcacaatttgtctttcgattgacgcggttgcgcacctccttaacgattttaacctccatcagctcaagcgacgacttcggcgcgccaatcagcgtgagcagatcctcgatctgctcgctttccttgtaatagagcacatagtcgttgcgacgctccgtgcgtttaggcggcgaaagcatctctgaaagcagcgtttcaagctcgccgcagagcgcttgatgcggtgtgacaaattccgcctggtagcttttttccggatccgtcaccgtgccgcacgccaaaaaagctccgctgataaagacgggcatatcgtcgtcagcgagcagctccctgcggatttggcagcagtcctcgccggcacggcatccaaaaaatgacagaacagcaatccggtccgtcacgctgtcgactgtcacaacaaatatgctgcgccggccggatcggcgcacctcgcgcatagtgatgctcccgcgcagcccgaccagatcagaaatactgtccgcatataagcgcgcgagcgtccggtgctccgtgtggatcgatatggaatccggtccaaacgtcttgccaaacagcaacaggccgtacgccagcgccttttggcggcgctggcgaaacggcctgttatgacagatttcatttttgatttcatatgcaaacgacatgaccttctcagtccttgtttttttcaatatcgcggtgcgttacagtacagcgcaccccctgttccttgatatgatcgccgagaagctgtgcaaatgtcaccgaacggtgtttaccgcccgtacacccaattgcaatcgtcaattgcgtcttaccttcatcattgtacagcggcagcaggtaatcgaccagggaaaacaaccgcggaatcaattcctgcgcttgttcccatttaagtacaaaatcgcgcaccggcgcgtcaagccctgtatgcgccttaagctccgggacataaaacgggtttggaagacaacgcacatcaaatacaagatcggactccttgggcaggccgtacttgaagccgaacgacatgcagttgacaagcatggaacgctttttatcgcctaaaaatgtggcgattatcttgtcacgtaactggcgcacagataaatacgtcgtatcaatcacataattggcattgtcgcgcactttggagagcaaacgcctttcttcagcaacggctgcttcaatcgacgtatttttgtcattcatcagcggatgcttacggcgcgtttccttataacgctggacaagcaccgcatcgtcgcaatcaagaaacataagctgaaatccgccgggcgcttccagaaactcctcgattccctcaaaaatatctccgaagatctcacggctgcgcgcatcaatgacaattgcaaccttgtcgaccttatccgcggcctgcaggcacaagtctgtgaatgatttgaccatgcgcggcggcagattgtcaacgcaataatagccgatatcctccatcgcagcgatcgcgcgggatttccccgagccggacatgccggtgataattacaaattccatacaacatcctttctgtatgatcataggctatccgatgtacttgacttcacattccagcgaaaagcccgtctgctcgcgcacctgtgtttgaatctccccaatcagcgtcagaacatccgtgcaggaggcattgtcataattgatcacaaagcccgcgtgtttctcactgaccatcgcaccgcccacacgccggcccttgagtccgcagccatcgatcagcgcggacgcatacgcgcccttcggacgcttaaaggtactgccggcgcttggatattccaacggctgcttcgttctgcgccgctccatcagatcgtccatacgcgccctgatcgcatcccggtcgccgcgcctgagatgaaaggacgcgcttgtaatcagacaatccgggtgatcggtaaaatagctgtgccggtagcttaattccagcgcacactcctccagcgcacgcagcttgccctgcccgtcaagaaaccggacggaccctaccacatcacggatttctccgccataagcgcccgcattcatatagacggctcctccaacgcttcccggaattccataggcaaattcaaggcccgtcaatccctgctccagcgcaaaacaacacaatgccgtcaagctcgcgccggccggacaatctatcaccgtttcatcgcgcagactgggacgcgcggacgcctcgtcaaatgacaaaaccgcgccccgcaccccttcgtcacagatcagcaggtcggaacccttgccgataaacaacagcggaacagacagctcccgcgcccgcgcaatgacgcgggccgccgtttctgcatcccgtggttttaaaagcaggtcggccggtcctccgattttaaatgacgtgtgcgcagccatcggctcatccgccagacagatgcagccgatccgttcacaatcctttcgaagctgtgcgattgcgttcatgcagtcctcccaaatcaatattgctttccaagcagcgccgcgccgatgatgccggcgtcattgcccagttttgcctgcaaaatcctggcgcagttttgctcctcgtggttaaaggtttgcggataggcgcgcgcacggacaggcccaaacagcgtttcgccctccttgctgatcccgccgccgatcacaaccgcctgcggctgaaacaggttgatcattccgctgaccgcataggctatataatcgatatactggtcaaccacgcggctggctgcctcatcccctgcgcgcatcgcgtcaaaggctgtacgtccgttgacatgatccaaactgttctgcgcaagctcccacatcttcgatttggcgttgagctgcattgattcgcgcgtcattctgatcaacgcggaaacagagcaatacgcctcgatgcagccgatgcggccgcaggtgcatgggacgccgccataaaccattcccacatgtccaagttcagcgcccttatagttaaaaccggaatagattttcccatcgataataataccgccgccgactccggttccgagcgtgatcataattgcggaatcaagccccttcgccgcgccggccttcaattcgccgtaagccgccgcattggcgtcgttttcgacgtaaacaggcttatcgacacgttcagctaccaactcgcccagcggcgtatcatgaaaaccaagatttgccgccagaccaacaacgcctgttctgggattgacggtgccgggggtaccgacaccgacccatacgacttcgtccatcgaaataccggcgttcgccgcagccatatgggcagcagcggccatatcgtctgcaatctctccggcgggatggaacgctttcgtgcgcacatttgcccttccaataatattatagttttcgtcaacaataccaaccgcaacatttgtaccgccgagatcaattcccacataatatcccatgcattcagccctccctttaaaatatgctgcggccgctcttttcacgcgcagccgctaagaaccgttcataattcgcattgaggatcaattcctccggaaaatccagctcacgcagcagcttgatcgattcgtccacacgcgcgatctgtgtgaaaaaatgcgcatcggagctgcaaacaacccgaacgccatacttcttgcagcagcgcgcgatctcccggcagttgacatccgattttggccgacattcgaatgagtgcgcgttgatttccacgatcttaccatattccgcaaacgcacgcaccactgtatcgatatcaaagcggtaccggtcgtcgcccgcatggccgattacatcgacatgaggatttttcgcgacagcaagccatccggcagtgtgttcctccggcgtggaaggctccacgcagttgatgtggtaggacgcgataacccaatcgagcgccgccagctttttctccgacagatcaagacggccacagtaatcaaggatattcgattcgacgccttttaggattgcaacaccctccagaaaatcaggcaccaccttaggcatattcccaaaatacatctcgcccggcgctcccggcatcgcgggtccgtgctctgttacacacaaaaacttcaatccgacgcgcgccgcctgacatacattttcataaatagtgctgtatgcatgatcacacgcgaccgtatgtgaatgcgtctctgcaatgatctgcatgatatctgtcccttcccgttctcagaaatcgccccagtccgttgtctgcgtgctgtccggctccaccatgccgagcttttccaaaagctcctgcgcagcgttgtagcccatacgcttttgacggttgttcatcgcagcgacctcaatgataatcgcaagattccggccgggctttacggggatcgtcaacgacgaaacctgcacgccgagcacatctgtatattcctcgttcatccccatgcggtcatagaccttggtcgcatcccactgttcaagctgaacgatcatattaattttctccgtcatcttgacggcgccgattccaaacaggcggcgcgcgttgatgatgccgacgccgcgcagctccataaagtggcggatattctccggtgaagaaccgacaagcgtcttggcggaaacacggcggatttcgacagcatcatccgcgatcaggcgatgtccccgcttgacaagctcgatggccgtttcgctcttgccgacgccgctttcacccagcagaaggattccctcgccgtaaacctctaccagcacgccatgacgcgtcacccgcggagccagctccacattgagttcggcgatcagccccgccataaacgcggacgtgccgtcagccgtgcgcagcagagaaaccttatgcgccttggccgcatccatcatacaagccggcgcttcaatattgcgtgtgataacaaccgccggcggacaggttgaaaaataattgtctattcggtttgtaatttccgtgtcgtcaaactgctgcagaaacgcaaattcactttttcccaatatctgtacgcgctgactgtcaaaataatcaaaaaaaccagaaagctgcagcccgggacgattgacttccggagaggaaattgcaatcgtactggcgtcctccggaacatagagcacctcaagattaaaatccttgatgatcttttgcagaggaacaataaattttgtagccaagaaaaccacctctcccatccattttgcgtctatattcaatttttattatactctaattgcctacgtctttcaaactttattttgggcaaaaatgtatttcctgcggcggttgaaatcatccgtatattgtattatacttaaaaagtatctatccaaagcctgtcccatgcggcaggccggaaaagggagtgtcttttgttgctcaaacggattgcggccgcggccgcctgcgccatcctttttttcccgaccgttatctttgccgaaagctccgagccgctgccgcctgtctccccggccggtcaggagagctggatttacctcgatgaaaatcccgcaggccctcaaagcatcgtcgcctactcgcttggcggacgcgatgtcaaggaaaacgcacggcagatgcttgacatcacactggaaagcggtatgaaggacggatttacctctgcccttgaattggagtattcgattctgggcttgatcaagctcggcgaaaatccttcctcatataatcgtaccgacctgatgtccatgctttatggttatgacaatatttttcgtgaaggactcgaaagcgcgctgtatgctctgatctcctacgatgcggcgaatacgcagatccccgcttccgcgcgcaattcggcgtcagctgttatcgactatgttgtttcctcacagcagcgttccggaggctttgcaatcgcatccggacgcgagccggatgtcaaaacaaccgcccaggctgtacttgcactctcgccgcatatcgatattccatatgtcaacgcgtcgctggacaaggcgctctcatggctttctgcccagcaaaacgcggatggaaccttttccctacaggcaacgcctgattgcgaagcaactgcacttgtgctgacggcaatacggacagccggcgtcgcttgtgatgatcagcggttcgttaagaatggacgcacgctgacggatgcgctctctgcattcgccgccggcggcggctattcccctgagcctggcggagaagccgacgtggcggccacagaagcggcaatcatcgcgctttatacaaatgaaaccgggctttcaccctatttgccgccgcaggcttatccaaactataccgccccaaagacagatgtaaagggcgtattcatccggttcctgttcggttttcttggtattttgctggtgctttacctgatcttgattttgacaactaagataggcaaaagatggggtaaatttccggaatccaaatcacaagcggacaaagctacgcacgatacgcaaacgcttgagatcaatattccaatgaaggcggagcttccaaattttgataccttgccctccgatacaatttatacacattctcccgctgatcgaccaaaatcataactaaacccgcccgccggcaattgccggcgggcgggtttccactgatcatttttattaaaccgcttctttcattaaaaaacgccgcataaattcttgacaaatcatgcggtttgtggtatctttttgacgaaagtttcttttaaatttaaaaatatcatattttatggtttttgtcaatatgttttttaaatttttttgatcagggggacagattatgagcgagcttctttccctgctcgggcggcacatcgctgcgccagcacggcatgagatcgaccatttgatgcaggtcaacgatgtcacccgcccctatgggctggccttgacgcacgaggatgctgtaaccgtcctcaacgcgcgcacgcaggccttgcgcggtagcggacgcattgaaattggatcgggagcggttgaccggttgattgaaaaattttgtgattccccctatatcaatgaggaaaattatgtcgagagcatttgccgtctgaccgaattattttactttatgaaatctgatacgcttgaccgtttaacggacgaggagctgctcgaccaaatgaagcaggcttttgacggctgttgcgaaggctcgattgacctgctcgccgaccgcgagcttgaccgcatagcatacaatattcgtgcatatggcgccaagtgcgccccttccgaaggccctgtcagcgaacaggcattcagcgattatgatgtagaggaggatggaacatggcggaccattcgcttataacgccgctgccaatcgatgtctccagtcttgacccggacgattataccgcttctttgacgcgtgctgcgatcaagagcggcctgctcggcggacaagccctccaaaccatgcaggatcagctttttggcattctgcacgatcaaatcgaacaagcaacacatggtgaaagcacctctgttccagaggaatccgccgcacagcttatggatgggatcggctactgtatcgatattgcattaaagaattgttcatcgccggaggacagcctttcccttttgaaaaatcaggcaatgggcgagctttatcagatgggcgccgcgattctttcagatcatgcacgtgcctgcgaacggctgctttcacgtgtacgggctacacgtacaaaaaccgtaaacgaaggatacaatattctgcttgacagcacgctgcctcaatatgtgcatgattggaaagcagcgcgctttccacgcaattttattgttatgacggaatatccgcttgctgatgaacgcgcgtcaggcggtatcatcggcgtaagggatcgtctagagcagcttgcgcttgaaaaccgtttctgcggccgcttcatgggcgatctggagggactgttgtgcgattggtcgtatcaaaaccgcaccacacccaaggatgcatatgtcaatctgttcacactggctttccagaacgccgtattctgccatattctagggaaaaccggcgtcgagctttcagaggcggatgcaaatttattgaccaggcggctgactgcgcttgacgcgcaggaacgcggcaaattgattgcaggcacggtccagtcgcttctcgtacaatgggcctttgacaacgaacgcttgaacagttatctgtggcaagcttgtgcgcgcctttccaatgggctgaatgcggcaggcggttctcctgccgcatttctggctgtacagccgcaatcgcctcgtttttgctatcagggcggggaacgcctcagcgacgacgcgtttgctgcggtggtatcagaagtccttctctgcgacgacgccgacgagcgtgtcaaaatcattcgcaccgagcttcgcagcttggatgacctgtgtgatctgctcgccgcagactgcatttttgaggaagaatttctatctgtctacgcttcttttgatgacttcacctgtgcgctgcttttaaccaggattcctactgtatgggaagatgaaaaccggatgcgcgtacagaatgtgtatgattggcaaaaacaattctccattttctttaacgctttgcagcctgacgcacgcagaggtttgcgcgcattgtccgaaagtctgtacaattaagccggtgtaaaaccctgtgtacgcatcgcttgctttctgctctttcaaatgatatgatatacaacatatctatgattgctgaaaggagcaactacaccgtgcattatatcatccaaatctatcaggacggtgttgtgcaatacctatttaacacacgtatgcttgtgcaggatgtttctcttgccaaaccattttccacgcccgcacttgcaaagcgttatctttctaaatccgtcttttataaaggaaattggtccgttgtttccatcgacgaaaacggcgccattcaaaatacaaccgctacctatatgcatggcatcatgccataaggcaaaccatttttcaacaattcccatacgcatatattgtatttttttcgttgttcctgtataataaacgaagcaggcggctttccggcggggagagccgccgtgtcatgttgggtgctgtgtgacagcacattactggcggcgtgccgccatcggagggattttcttatgtcaagaatgatcggaacaacggttcgaggcgttcgtgcacccatcatacgtccgggcgacgacctcgcgcagatcgtcgcggattgtgtgcttcaagcggccgaaagcggcggtattgccttcaatgaccgcgatatcgttggcgttacggaagctgtcgttgcaaaagcacaaaacaattttgcttctgtagacgacatcgcggccgatgtgcgtgcgaaatttggagaccatcctgtcggcgttgtctttcccattctcagccgtaaccgtttcgccatttgcctgcgcggaattgcacgcggcgcaaaaaaggtcgtactgatgttcagttatccgagcgatgaggttggaaacacactgatttccgatgaaaagcttgaatcaaccgctgtcaatccatggaccgacgtactggacgagtcgaaatatcgtaggctgttcggagaaaataagcatatatttaccggcgtcgattatgtggaatattataagtcactgattctggaggaaggcgccgaagctgaaattctttttgccaacaaaccgaccgccattctttcctataccaagcatatcctttgctgcgatatccacacgcgtcagcgtaccaagcgcctgctcgcgcaggctggaggagaggcggtatacggccttgacgatatcctctgcgcgcctgtcaatggtagtggcttcaactgtgagtacggcttgcttggcagcaacaaatcgaccgaggagcgtgtcaagttgttcccgcgcgattgcgatcagtttgtgacatcggttcaggaaaaactcagctccgcgaccggcaaacgcatagaggtgctcgtttatggcgacggcgctttccgcgatcccgtcggaaaaatatgggaactggccgacccggtcgtcagtcccgcttatacgagcggtttggaggggcttccgaatgaactgaagctcaaatatctggctgacaatcaatttaaagatttgtccggcgaggcgctcaaaaacgcaatggcggaatatattcacaataaacgcgccgacctcaagggaaccatggagacgcagggtactacgccgcgccgcctgactgatttgatcggcagtctatgcgatctaacgtccggaagcggcgataaaggaacgccgattgtatggatccaagggtattttgacaacttcgcggattgatggcatcttcctgatttttataaattcccgatttttttagatcctgtctgccgtgattgaatcaggaaagccggcctttagccgcaggcggaacacgatctgtaaaaagcagccggaaacggggacgtttccggctgcttttatactatgtacaatcaatttgtttcctgctcctgacgtcccgcgcgcgcttccagaagggattgaagctccttcataaacgaatcgatatctttaaactgacgatatacggacgcaaatcgcacataggctacctcgtcgatcgcacgcagcttttccatcgccagttcaccaatccgataggacggcacctccttgtcgagggaattgtgaagcatcatttcgatatcccgcaccgcgtcctccagaatgccaagcggaacagggcgcttctcacacgcgcgcacaagccctgcaagcagcttgccgctgtcaaagccctctcgcgacttatcttttttgatcacaacaagcggcgtcgtctctatcacctcatatgttgtaaagcgccgttcgcatttgaggcattcacgccgcctgcggatgcgctccgattcgtcagtcggccgcgaatcgatcaccttgctttcaacatatccgcaataagggcatttcacgcggatcactccctttcaaccgaatccgcatacagcggaccataaaagtaagaaaatacctgcagttagcataccacaaaaccaaaacaaactcaagccgttttattcaagtgcgctttcaatcgctgcacatatattttgatatgccgatgataattcctcatattccccataactgtcccggtacagctccaggattacgccgccgtcaaagccgttgcctctcacctgccgcagtaaagcagtcaaatcaaaatcgccggttccgatcggcaggcagtcgttttttgcgttgtgatcgctcacatgcagatggacaacgccagatcccattgcccgggccatctcgccgggcgtatagcccgcgcgcacagcttgtttgatatcgagcacaaaccgcgcgtccggcaggtattgacgcatatcgcgaaaaaaatcagggcaatagctcgcgcagcgaggaacattttcctgtgcgacggttacacccattgcacgtccctctcccgccagctctccaaatgcatcgaagtatgcagaacgcggcttttgagatatacgacggtcgccatgcagcacaagcagattcgctcccaataaatttgccgcatgaaaataccgtttataaagctctaccccatcgcaaaagcgtctcctgtatccggaaaaaaacaacagcggttcaaggcctgatgtaaagggatgaacagataaaatacgcgtgcccgagccatcggcgatccggcgcagttcccgtacaaagctatccgtcagctcactgggcgcattgaaaaagacctccgccgcctgcgcgccgatcgatgcggcaaacataaggccgcgttccgtcaattccggataaaagcatgccgtcgataatcccgccaacacggcgaatccctccttcaggcagagcggcttttgccgcctgcttatgagcatcctattccatacgcgccataaatgcgcgtctatccaaatgagccgccggtaaaccggcggctcattgagcgttcgttacgaagctgatttctgtgcgcgtttacgctcctgccagaaggcccaaaggggaccggaaataaacatggaggagaagaagcccgcaaacataccaaccagcagtggcagcgagaatgtcaagatggagttgacatgataaatcagcgacatcgcgcagacacatccaaccgcaatcactgtcgaaactgtcgtattgatggaacgcgtcatcgactgattgaccgaaagattaaccagatccttatacgtcgtcttgacaggcagcagacggcggttttcacgaacacggtcgtagacaatgatcgtgttattgatcgaatagcctaaaatcgtcagcataactgcgataaagctgtcattgagcgggaatccgcagatgacaaacgcaccgtaagcgatgatcagatcgtgcagcagcgccatgactgcgattacgcccgccgaccagccgttcattttgcggaagcggaaagcaatgtagatgatcatcaaaattgacgccgcgacaaccgcgacgatcgatttgaggaagaagtcgcgcccgatcgtcggatcgacattgctaatgctggcggcatttacattgttatcaggaaactgcgtctgaagcgcctcattcacagcaatctgctgatccggcgtgataccggatttatttgtcagcgtaatgatataattcggcagaccggtattgacatcatactgctcgcgcagcgtaaccggctggccgagcgaatcctcgaccgtcttttcaaagctggccttatccgcctgcccggtaaaggtatacgtaatgattgtaccgccgctgaattggatatccagcttgacgcccaagacaaacgaggcggcaataatcaaaacaatcagcgcggacgatatggaaaaccaaattttccggcgtccaacgatatcaacctgtttcattatttcgcacctccatacagccagggcttcttaaacggtttgaacttcgaaaccgacttaagcatcagccttgatgcggtcacgcccataatgaagttgaagatgacgccgacgatcaatgtaaaaccgaacgaataaatcgcaccggtcgcggacggaccaaaccaacggaaaatcggcgacagaagcgaattaaagatgctctgcggcggcccaaacgcccccatcaggatgattgcgacgatcaccatcgtgatattgccgtcaaaaattgcggaaaatgtacgctggaaaccggaatcgatcgcaccgtcgagcgttttgccgttgcgcagttcctctttaatgcgttcggaggtgatgacgttcgcatcgacgcccataccgatcgacaggataatgccggcgataccgggcagcgtcaatgtaaacgacgggaacggcgcaaagaagccggtcagacaggcgatcatgcctgccacctggccgacgagcgcaatagaggcgacgacgccgcacatgcggtacatgatgatgataaaaatcgcaacgagcacgaaagcgatgacgccggctgtgaccatcgcatcgcgcgcgccgaagccgagcgtcggtgaaatggtggagaaattctccgtttcaagcttaaagggaagcgcaccgccattgatgcggtcggcaagcgccttggcctccttgacatcaaagccctgcgcaccgcctgtgatataggcgataccgccggggatctggctgtcgacgcgcggtgccgaaatcatcgtgtcatccatccaaatcgaaatctgctggccaatcagccggcctgtagcgtcggagaacagttccgcgccctcgtcggtcaactcaagcttgacctgggagccgcggccgtcgggcgacggctccgcgctggcagattttacatgctttccttcaatcacaaccggcccgctctggttttcacggaatgtcaataaagccgtttcgccaagctctttgaccgcttgctctgggttaaagtctgtttcgccctctttccagggaaagcggacaatgatgcgatcctttgcctcgtcgacatacgtctcataatccgtgatgttctgcgacaccaggcgtactttgataatggattctgcggcggccatctcctccggcgtcgcgtcgtatccttcgggcggcgtaaacgtcacgtcgacgcccccgcggatatcgataccccaacggatatcgtcaacgcctttgatataggtcgttgtgatatcgccgtagcttgtcgatatgccgaagaacgccaatgtcgtgaaaacaatgataatcgccacaacgacgaaaaccactggttttccaacctttctcattaacttgtcctccttgcaaacccaagcccgcgccctgcgggcgtcggcgggacgatgattgctgtccggccggccaaggtttcatgatgccacgcgcgctgcgctttcccccggatcaatccggacccgcgcaatgcgacacttttttaattatatgggatacggttccaaaagtcaattcattttttggcaggacgtgtgcccgcaccagtcagagtatgcccgccttttactccctttagacggaaagctgcgcgcgttctccaagcagtccgctgttttcatcgagcatggggcgcacaacgctgctcagatattcttcgacctgctgcgcgcttcggcctgtaaaacgcgaaggctccagcacagcctctacatcctcgcgcttgagtctgaaagacggatctccgcaaatccggtcgatcaaatcgttttcttccccctcctccttgacacgcctggccgcggcgagcgaatggacgcgcaggcgctcatgcagctcctgccggtcgccgccgcggcgcacagcgtccatcatgatgttttctgtcgccatgaatggcagttcgcgcataacgcgctggcgcaccaccttcggatatacgacaagcccgtcgcagacgttgagcataagctttaaaatcgcgtctgtcgccaaaaacgcctccgcgactgcaatgcgtttattggcgctgtcgtcgagcgtgcgttcaaaccactgtgtcgaagcggtcagggcaggattgagcgcatccgtcataacatagcgcgccaacgccgtaatacgttcgctgcgcatcgggttgcgcttgtacggcatggccgatgaaccaatctgatgtgcttcaaacggctcctccatctccttgaagttggcaaggatgcgcagatcgtttgaaaatttccccgcgctctgtgcgattcccgataaaacattgaccaccaggctgtcaaccttgcgggaataggtctgcccggaaacaggcacaaccgcttcaaaccccatctgttcggcgatatcggcttcaatcgccttgatcttttcaccgtcgccgtcaaacagctcgacaaagcttgcctgtgtgcccgtcgtccctttgcttccaagcagcttgagcgatgcgatgcgccgttcgcactcctcaagatccatcattaattcattgatccaaagcgtcgcgcgtttgccgacagtcgttagctgcgccggctgcaaatgcgtataggcaagcgccggcatatccttatatttatccgcaaaaccggcgagcagcgcgattacattgatcagcttgcgccggataacgcgcagtccctcgcgcattacaatgatatccgtattatctccgacatagcagctcgtcgcaccgagatggatgatcccctttgcaccagggcactgtacgccgtaggcgtaaacatggctcatcacatcatgacgcacctctttttcgcgcgcctgggctacatcataattgatatcctgtgcatgcgcctccagttcggcaatctgcgcgtctgtaatcggcagtccctggcgctgttcggcttttgcaagcgcaatccatagcttacgccaggttttaaacttattgtcatttgaaaaaatatactgcatctcctcgcttgcgtagcgggtgcagaacgggctttcgtaacggtcgcgcgccattttgcaacatcctttccctctccggccgcccgggccggcacaatataacgaaacaagtataacataaccggcggatgattggaacaatcatccgccggttttccgatctttactccccttatgaacgcaacagcttttcaaccgccgccagctttgtacagacacacagcagcgaaaccgcacattcaagttccggtatggacgggtacgtcggcgcgatacggatgttacggtcatgcgggtcgtccccatacggataggtcgatcccgctgaagtcagcacaacgccagcgtccttgcaaagctgtacaacgcgttttgcgcagccatccatcacattgagcgagatgaaataaccgccgtttggattgatccattccgcgacgcccttgccgccaagctccctttcgaacgcatccaacacagttttaaatttcggacgcagcagctccgcctgtttatccatgtgcgccatgataccgtcaagattcttaaaataacgcgcgtgacgcagcatattcattttatcaaagccgatcgtttggatagtcagcagctttttcatgcgctccatcacttcctgcgcgcatgcaaataccgcgatacccgcgcccgcataggtaattttcgacgtcgacgcgaaaatcatcacacggtttggatctccggccttcttgcattcatcaagaatattgatcagcgtgtcgcgatgctcaggatgcagatcatgcactgcataggcattatcccacatgatcataaaatcatccgcagccgttttcatccgtgcaaagcggcggaccgtctcgtccgaataagtaatcccgtccggatttgaatatttcggcacacaccagatgcccttgatcgaagcgtccgatgccgcaagccgttcaacggtgtccatatccggtccctcaggcgtcatatcaacagggatcatctcgataccataccgttcggtgatcgcaaaatggcggtcatagccgggaaccggacagagaaattttacacggtcaagcttgcaccagggcgttgcgccagggcgcacgccgtgcagaaccatcttgccgatggcatcgtacatgatggaaaggcttgagttgccgcagatgaacagctcgtcaaagctgacgccgagcatatcgcagaaaatggccttgcattcggggatgccgtcaaaatcaccgtagttgcggcaatcgacaccatcggccgacagtggtgaagccgtcgaattcacaacgtcgagcataccgctcacaagattcaactggtcaggcgagggttttccgcgcgacatatcgagcctgagattccttccctgataatcctcatattgtccgagcaattctgtatgcagcttctccagttcattccggctcagttcactgaataatgacattgttagaatcctcccatgcccggctcttttttaaaaggccgcggcgaatacttttgcgtcaggccgcaagcggcctggacggctgttttgctgtctgaacggcgttttgcataaaccggaccggctggcgccgccgttttacacacaaatccaaaacaaaacaaccgccaaagcgattgtttctacttctatagtatatgcgaaatccatcttttttgcaagattaatttttgattcttgcaaaattcatgattctgaacgagaatcaacccaagttttgactgtttttcagttgaaaacgcccgccccgcctgtcaggcggaacgggcgccgttatcagtattcggcggaaccggtggtacgcgggaagggcaaaacgtcgcggatattggaaatccccgtcatatacatgatcaatcgttcaaatcccaatccgtaaccggcatgctttgtaccgccgtagcgccgcagatcgagataccagctataatcagcaggatcaagcccaagctcgcccatccgggacaacagcacgtcaaggcgttcctcgcgctggctgccgccgatgatctccccaatccccgggacaagcaggtcaaccgcagcgaccgttttccggtcgtcgttcaggcgcatgtaaaacgccttgatctccttaggatagtccgttacgaacaccggacgcttcatgacctgctcggtcagataacgctcatgctccgtttgcaaatcgcagccccaataaacgggatactggaactgatccttcgccttctccagtatctcaatcgcttcggtgtaggtaatatgaccgaagtcggaagaaatgatgccgtccaaccgctcaatcaatcccttgtcatagaagctgttgaaaaacgccatctcctgcgggcactgttccagcacataggaaaggacatatttgatcatatcctccgcaagctccatattgtctgcaaggtcggcaaaggcgatctccggctcgatcatccaaaattcggcggcatggcgcgccgtgttggaattttcggcgcggaaggtcggcccgaaggtgtaaatcttgccgaacgccattgccatgcactcgccctcaagctggccggaaacggtcaatccggtggcctttccaaagaaatcctgcgcaaaatcgacagcgccatcctcggtgagcggcgggtttttcgggtcaagcgttgtgacgcggaacatctcgccggcgccctcgcagtcgcttcccgtgatcagcggcgtgtgcgcatagacaaatccgcgctcgttgaaaaagcggtggatagcatacgcagccacacttcgcacgcggaataccgcttcaaaggtattggtgcgcggacgcaaatgcgcgatcgaacgtaaaaattccagcgtatgacgctttttctggagcgggtaatccggcgtggacgcgccttcgagcacagcctcgtccgcgtggacctccagcggctgcttggcctgcggcgtcaggatcacgcggccgcgcacacagatggcgctgccgacattgagctttacgatctccgcgaaatttgaaaccttctctgtctccagaatgatctggaggttcttaaacgccgaaccgtcgttcagctcgataaatccgatggctttggaatcacggatggtacgcacccacccgcatacagtcacttcggcgccgtcaaatgactccggcgcagcaaatagctgtctgatttctgtccttttcacaatgctccctctttccggtgcggccgttttgcgcaatgcacctgcggcccaatgttgatgaatggtattatagcatagcttaccttcaaaatccagccctttacgcggcctgcgccgggccgcccgaagcctgcgtcccgcgtgcacgatcgacatattcctgcacatgcgcgcgcaccatgtcaaacggctgcggcccagcgtccagaatcgccttgtgtactgcgaggatgtcaaattggtcgccaagctgtgtacgtgcgtcgtcaataatgtcgatcagttcaagataaccgatataatacggcagatatgcgcccggatcggccacaatcatccaataaaaatcttccgcgtcgctcgtatcaaatccaaagccatcgagatacgcggcgaactgttcgactgtccagccctggtaatggatgccgatatcgctgcgcgccagcacgccgagcgaaaactcattgttgatctggagcagctcgatcagcgcgggatcgtcaaggccggccagctcataggaatacagctcggcataggtgccccatccttcgctgtagcccatgtacgaaagaagatggcggagcatggcagggccggtggaaataaagtaattgttttggtacatgtgcccgggatacgcctcatgcgccagcgtggcatagaggatggttcccgaatcgcggccctgattgatatacagccggttttcagccggcgcatcgaccggcgggatcatgtagaaagccggtgcggtgctgtcctccagcgatggatcgacgtacagcacattgtaggaaatgtcgcccgcgtccgggaaaatcccctccgacgccgcatgcaaaaagtcgatctgttcgcgcggcgtgccgcggtcagcttccaaaaacgcctccatctcgcttatcagacgttccgacgtttcatcctcacccaacagcaggaacatccgtgaaaacagttcgccaaaccgttcatcgatccggcgggccagttcatccggggctgcatcaacgccggtcaggctcctggcaaggtattcataataccccttccccttctcaagatgtgaaagaccgccgggatttacgcctgttcccttgagcttctcaagcccttccatcatccgttcataggccggaatcaccgtgtccatgactgccgcatgattttgtttaatataatcggcgcgcgcctgttcatcaaggctgtcgagcgcatccagccgcgtctcaaatgtcgcgattaaaacattctgttccggattggcgataaaagtccgacagccttcaatcacctgatcaaccatatcgtccgtcataaacaggccgcggcgggcgcgttcctcctcatacttgaccaggtcgtcgtaatagcgtcccacgtctccaagcaaagcgatgtaatcccgcacgtcctgctctgtgtaaaactgatattcggacagggtgatcggcaacgacgcctgcacgcctccatcgggcgcacatggctccgaataataggcgtatccctgctcaagcgcgccgcgctcctgccggtaaaagcgcatcagcatctcataaagctcctgctgctcctttgtcagaagggaacggtcaaatccttccagccggtcgatttcctcatcgtagtcggaaagcagcggcggctgcacatccccaaaggtcggttccacatcttcaatgccatatgccgccgggtctttgagcgtataatgcagcgttaaaagatcggattccagtgttgcgacaaaatcctcctccaggtattcatcgaagcgcgcacgttcctcgtccgcatttgcacggctgccgtcctctccagccccgccaaacggaaccgggccgttgcaggccgctgtgaaaaaagcgagcatgcccgctgtcagcagcgcggcaattttttttatttttatcaaacaggctcctcctatcaatcaggttgcccttatactttaccacgcgacaggctgttttacaagcgcaccagttctctggcgtttctttcatatcaaaacagacaaaacaaccccgtcctgccgctttgcggctggcgcggggttgttgattgcaagtttgtaaaaaaggcaaacaggaattttcaggtaataaattattaatatggaagtcagaggatcagccgggaggccaagcgaggctacgccctgcgagcacatgaaaatgcagatgcccaaccgtctgtccagccagcttgccgcagttggtcacgacacggtaatcgccgccgcacccaagctgctgtgtcaggcgcgcgatcacagcgaatatgcggccgactgtcggggcgttgtcctccgtaatctggtcggcgccggtgatatgcgccttgggaacgaccaggaaatgcaccggcgcctgcgggtcgatgtccttgaaggcgtaacagatatcgtcctcatagagcttatcgctcggaatttcgcccgccacaattttacaaaacaggcagtccattgttgtcctccttttgtacgtttattttaacagctttccgacaatcgcgggtagctgcgccattgcttcgtcgatccgaaatatttcagacgtgccgcccatcgcgttgtcagggcggccgccgccgctgccgccgcaaagcgcagtcagctccttgacgatttttccggcgtgcgcacccttagcgaccgcgtccttgccgcagacgaccagaatggaacctttgccgtcattgacagtcgagaaggcgcagacagcatccggacggctgtcgcgcacacggtcgcccatacggcgcagcgcgtcaatcttcgctcccatcattgcgacagacgcgatgtatatgccgccgacctgctgggcattgtcaaacactcctgaaagctgcgattcggccagctttgcctcggccgcctcaagccggcgcttctgctccctgctttccgcattaagcgcctcggcgcgcgccggcaattcagacagattgccgaccttgagggcggcggccgtcttttccatcgtcgtttcctgctcatccatcagacgcagcacattgcggcccgtgacggcctcgatgcggcgcacgccggccgcgacggatgactccttgacgatcctgaacaagccaacctgcgcggtatttttcagatgggtacctccgcacagctcaaccgattcgcctggaacactgcaaacgcggacaacatcgccatatttttctccaaacagcgccattgcgccgagctttttcgcctcgtcgatcggcatctcgctgacggaaacgtcgatggaagcgagcacaacgcggtttacaagctcctcaacccgctttagctcctcaggtgtgaccgcagaaaaatggctgaagtcgaaccggcagattgtatcgtcatagaaagcgcccgcctgatgtacatggtcgcccaggacctggcgcagagcagcctgcaacagatggcaggcggtatgattgcgcatgatatcggcgcggcgatcgacgttgattgcggccgaaacagaatcgccgaccgcaagcgtcccggcggtcaactcgccgatgtggacaaagtggccggtttttgactttttgcagtcgtaaaccgcgaatacgtttccacccgcgctaatcaagccgctgtcgcccgcctgaccgccgctttcggcataaaagggcgtaacgtcgagcacgattgatccaagctcgccgtcgtgcaactcatcgacgcgcttgtcatccttgatgatcgcgacgatatgtgcctgcgcggccatttccgtgtatccgacaaagcggccgtgatcggctacgtcggcaagcacgtcctcctcccatccgaggtcgccgagcgcggcgcgcgcttcgcgggcgcgctgcttctgcgcctgcatctggcgggcgaactcctcctcgtccagcttgatcttgcgctcggccaggatttcacggatcaggtcaactgggaacccatacgtatcgtacaggcggaacgcatccgcaccgggcatgatctttttgtccatctccgaatcgatcttgtcgatgatcgcggtaagcagctccataccctggtcgattgtgcgggcgaaccgctcctcctcgaccttgataaccttggtgatataatcgcggtgttcaaccagctccggatatgcgttcgcattttcctggatgaccgtctcgcaaacctgatacaaaaacggctcgtggataccgagcaggcgtccgtgacgcgccgcgcggcgcagcaggcggcgcaggacatacccacgcccttcgttctgcggcaggattccgtcgctgaccataaatgtggtggaacggatatggtcggtgatgacgcgcagggaaacgtccgttttcgcatccgtatggtactccacgcccgcgatccgcgcgacatgttttaagatattctgaactgtgtcgacctcaaagaggttgtcgacaccctgcatgatgcaggccagccgctccaggcccatgcccgtgtcgatgttcggatgctccatgcgttcatagtggccgttgccgtcgccgtcgaactgggaaaacacaagattccagaactcaacatagcggtcacagtcgcagccgacgccgcaggtcggcttgccgcagccgtactgttcgccgcggtcaaaatagatctctgagcacggaccgcatggaccggaaccaatctcccagaagttgtcctccttgccgagccgtacaatgcgcgacggatcgacgcctacttcctttgtccagatctgttcggcctcgtcgtcgtcctcatagacggatacccacagacggtcaaccggcatttcgagcacctttgtgatgaattcccaggcccaggcagttgcctcatgcttaaaatagtcgccgaacgagaagtttccgagcatctcaaaataggtgccgtggcgcgccgttttacccacattttcgatatcgggcgtgcggatacatttttggcacgtcgtcacacggcggcgcggcggcgtctccagccccagaaaccactttttcatcggcgccataccggagttaatcagcagaagactggcctcgtccgccgaaggcatcagcggaaaacttggcaggcgcagatgctccttgctctcaaaaaaactgaggaatttttcacgcagttcattgagtcctgtccattccattgtctcaatcgttcctttccatacttgccggtccccggacgcgaaaatgcgcttctcgccccaaaacatgggacgaaaagcgcatcggctttccgcggtaccacccaaaattgcgcgggagtcgcccgcgccgctcatcaggattaacgctcacacaacgtccggctcgccgccggaggactccggggcggcgtccgcttctttccgcggcgcgctcacagcatacgcgcgcctctctgcggcggcttccacggttgaccccttcatggtccatacggatattaagtatataccttggcgcgctggaagtcaaccgcagcgcgtatttttgcttacattccatcagaatcagaccgaaaagccggacttcggcatttccgactgctccaccaaagcggacgacgcggcgatctcgtcaaattcctcccggcattcgctgaaatattctgcgggggctgcctgcaccaaaaccgcgaacgcatcggaatatcccgcaaattcaatcagcgtgaaataataagccagtttctccccatccgattcagctgccaaaagaaccgttgtatagcggtgcccgtcgtcctcacggactgtatgttcctccaagatccgcgcattttcccgtttaccggcgaaatccttcacatggaaatcaagcgcctgcgccggatcgaacgcctgcgccgcgcctgcccgcgtgtaggaaaacacgccggcagccagatcgcgcgttttggcatagcaaagtaaatcgtatgcatagctttgcgcgtcctgcgtccaatccgcgccaaacacgaaggaaatcgccccgtcctgcgtgacgcagcttaatggctttggttccggaacggcctgtacaggctgtttcttggcgcaggcgcagagcaacaccatacagagcagcgcgcctatgacgcgccgccctatacgtcgtgtcacggcgcttgcaccaattcgcgggcggtcatatgacggcggccaacagccgcgcacggcccagcgcacgataaagcgcacttgcgagcaccgccgatatggccgctttcacaatgtcgaacacagcgaacggcagcacgccggcagcaagcgcctccattggactcatacctgaaaggacgatcagctggagcgtaccgagcgtatagcacacaaacagcgaaagcagcatagcagcgcaataacgcaggaaaccgcgtccaaaccgcttcaaaaacagcgccgcggtcagcgccataaagggataagcgagcagatagccgcccgtcggccccgcaagcttctgaagcccgccggaaaagtaggagaataccggagcgccggcggcgcctatcagcagataagcaagctgcgccagaaacgccgttttgggatcaagcagggcgcctgtcagaaaaatcgcgatcagggccagcgtaaacggcaccggcgtaaacccaagcgggatgacaagctgtgccgtcacggctgtgatcgctgcgaacattgccgccagaacaaggcggcgcatcttttcatgctgcatctttgaacacctctcttaatttttcatagtaaatccaacggctatcatccgcttaaagttattccacggaaatggtgaagtaatagaccggctggccgccgttaataagcgcgacttcaatatcgtcaggcagcttggcggcgacggcatcgcggatcgtctgcgcaagctcgtcagagatttcctcgccataaataagcgttacaaaactgctgtccttgtgcacaagcgcacgtgttacgcgcacaacggcgtgcgtcagatcgtgatccgtaaaggcgaccttgccattttcaagccccagcagctcgccctccttgattttgtggccatcgtaatcgctgtcacgcgccgcaaacgtaacctgtcctgtcccgacgcgctcatatgctttctgcatggctacctgattttcagttgcatcggcgtcggcatcgaatgcaagcatcgccgaaaggccctgcggaatggtgcgtgtctgaagcacgatcacgcgccggtcagccagctttgtcgcctgctccgccgccataatgatatttttgttgttgggcagcacaaatacggtctttgccggcgtcgcatggactgcggacaggatatcgtccgttgaagggttcatcgtctgcccgccgttgacaatgttgtcgacgcccaaatcctcaaacagcttctttacgccgtcgcccgcggcgaccgcgacaaagccataggtgcgggaagggtcaaccggcgcgtatgcaaacccctgatcggataccggttcgacaacgctggccttctgcgcctcatactgctcgcgcatattctcaatttttaggttcgttaattggccgtcctcacccgctttttcgagcgccaggccgggatgatccgtgtggacgtggcatttgatgatgtcgtcgtcgtcaaccacgacaacacaatcgccaatcgtctccagataggcgcgcaatggctgagggtcgatatcccgcgcgcgctttttcacaagaaactccgtacaatatgtgaacgtgatctcccctacatattcgccagccgcgttgcggtccgggtggatggaatcactgtctgcggcggctgatttttcaacggcaggctcgattccctttttaccatgaaatacctccgacatcccttcaaatacgacgatcaggccgcggcctcccgcatcgacaacgccggcctttttcagcaccggcagcagctccggcgtctcgtcgagcgcctgacggccagcgtcaagcacaacgtcccatatctgcgctgtgtccatttcgtcggtcagcgcctcacgcgcccgttcggccgctacgcgcgcaacggtgagaatggtgccttccgtcggcttcataacagccttatatgccgattcgacgcccctttccagtgcgtcaaccaaatcccttgcatccgcctgctcccgtcccttcagcccgcgcgaaaatccacggaacaaaagcgataaaataacgcccgaatttccgcgcgcgccgcgcagcagagcagaggcgcacgcatccgcaacctgagaaacaggcgcgctgtcgggaatgcgcatcagctcacgcttggcggccgacgcggacatggacatattcgtgcccgtatcgccgtccggcactgggaacacgttgagcgcgtcgacaagctgacgctggtttgatatattgttggctccggagatgaacgcatccctgagcatctggcctgtaatcatgattgaatgacccccatattcacacttttgtccgcctcagttatgcgttttctgttttcattgcgtcaacgaatacattgaccttagctacctcaaggtttgtcgcctgctcgactgtataacgcaccttgttgacgatactgcgtacaatcgcagcgatattcatcccataaacgacggcgatgtgcaaatcaacgatcagccctccgcctgaggtgcgcacatgtacgcccttatctggaacatccttgccgccgttcatgatcgaccggattccctgtgtgggcgagctgatcatcccgacaactccaaagcactccgacgcagcgcgccctacaagatttgcaaaatattcctgggatatttcaatcgtcccatactgattttccaaactgatcaatgtcaaaacctccctgtattctcatacattaaagcaatgctaccattcagataaattataaaaaagattttgttctgtggcgacaatctgcgcatcgaacgaacgattaaacgatacctgtccctgtcgaaatacaagcggaataaacggcgattgttcagcaaacgcttcgcaaaacgtcccgatccccgccccggtcgaacgataagacccataaagctcagaaagcgattcgatatatggagttgaatagctgagcgcccctccggagagcaggacggaaaaatccatattatccatcaagcgtgtctcgccgatgtacagatcgtagtcacggcgcgaaaggctagcctggtactgtgtaaacgactgcgattcgacagtcacctgtacgccaagctggcgaagctgttcggcaagcagtgttgccgctgcattgcggcaggcattttcgctgttgaccagcaggcgcagcgtcacgggttggccgtttctcaagcggtagccgttttcatccttttgggtcagacccatgccggcaagaagttcctctgcacgcgcaagctcgcgcggcgtcgaaagctcaagatcctccattctgtaaaactccggattaaacggatacagcgtcgcgcgtgcatgtgtcatatatgcctttgcaactagctcatcacggttgatagcaagggaaagcgcctgccgaaactgcgcttcggacagcagtccccgatttccattgacaccgatgtatacaaggctgtttagagataccggcacgccggaagcagccgaaaatgtaaaatcaccatcgctcagatcggaatacatcaaatcgatgtctcctgtacgtaaactgaacgaaagcgcatctggatcagaaacatttgccaaacgaatcgtttcaactgaacccaccgactgcggattccaatagatcgggttgcgcgtcaatgtcacaccgcttccgccccatgtgcctgaaacaaagtatttgctgacgccgaccggataatcgtccgcagccgtcccctctttaacaattggaaatgacagcagggcggcaaagtcagcgtcggaactgtaaaggcgaatttcaactgcgccgtcgtcgttgactgagcagcctgaaatattttgcagcgtcgttttccagtcagtgttagacgccatcgccgtcgtaatggaataaatcacatccttcccggtcagcggtgatccgtctgaaaacacgacgcccgaacgcagcttgaccgtgcacagtttgttttcaaccgtaatttcttccgccaatatgttctgcggacgccaagtcttatccaccctcgtcaggctgtcatacaaaagcggaatcagcatacgattcatctgtgttttcatcaaaaatggattcaacgaatcggatacgctgtaggccaggctcagggttgtcagcggctcctctgactgctcctggcgctgtgctggcgcggaagcctgcgcccgctgcgcagcaatgtcaaactgctgatcgcttacaactgtacgcctgcatcccccgaaaagcagcacaaccgctgccaaaagcgccaaaattctgtgcgtcatcgcattctcccatcaatataaactgtgatcgcagctcattatataacacaaacgacgataactgcgcaaccggcatgaaatgcgcgtagtccgctactttgcagcggttttgccgtctggcggccgcaaacggcaaaaccgttcgccctgcgcatattataccctatactgccacatatttcaacgaaactttagaacagtttacattccgctgcataccaaccatggagcaggccgccggctgcaaaaaactgagggggctttaaaaatatctgaacatttatcccctctattttgctatcttctgttcctttaaataataaatcaatctattccatatttttcatcttcaaacggttctcttacatattttctcatattcttttcacaagccccaaattcaataaaattgctccgtgcctgaagcaaacttacagtgttcgcaccgccctcaaaggtttcatcctccatttgtatcgggtcatcttcccaaaaacatacaggacatatatcataattcccgtttggtcgttccataaacgtataaaaaccgcaacatggacaacgatacttcaaatttttcctctccccgctgcttttcaaacaaaatctaggccggcgcaaaaatacgctcaatacggccaacgcgcccagatgtaccttcgaatgtcaaaagcacgccatgcagttcgatctgttccgggtcgttagagaaccgatgcggcagtcctgtgcgcagcttttcaatcgcgcggcttttttcaacgccaagaatcgaattacggccgccgcacataccgacatccgtgatatacgccgtaccgtttggcagcagacgttcatcggccgttgtcacatgcgtatgcgtaccaagcaccgctgaaacgcgtccatcaaggtaatgtgcgagcgcaagcttttccgcagttgcctccgcatgaaaatcgacgacaatattcggacatttaatctcagaaagcaatacgtcggccgtgtcaaatggactggcgagaggcggctccatatagacgcgcccttgaagattgataatcgcaaccggaaacgctggactgtcataaaggtaccagccggcgcccggcgcggaaggatgataatttgccggccgtataattccgttttgctcgtcgagcttcggataaatttcgcggcggcgcagcacatggttgccggtcgtgatcacatcgacgccgctgtcaaaaagatgctgcgcgctgtgcggcgtgattccattgccttcggccgaattctcgccatttgcgatgacaatacccgcatcatatgcacggcgcagacgcggcagctcacgccgcaatttgtcgcagccgggctgtccgaccacatccccgaaaaaaagtatgttcatgtatcctcctgactcaaaagacctgcggcgctgtacttgcaccagaatccttgcgccgcgaaaaatatacgaaagcggcggagcgcaccctggtgcgctccgccgcttaattgatccgcgccattaaaaaaactataccagaaaagatacagcgccgtcaagtcacagcacctttgacaaaaaatcctgcaggcgcggattttcaggatgcgtaaagaatgtttctggaggcgcctgttcaacgatacgtccctcatccataaagagaacacgtgtggcgacctcgcgcgcaaaacccatctcgtgcgttaccacaaccattgtcatgccctcgcgcgctagctggcgcatcagttcaagcacctcgccgaccatctccggatcgagcgcggaggtcggttcgtcaaaaagcatcacatctggattcatcgccagcgcgcgtacaatcgcaatgcgctgctgctgtccgccggaaagctgcgacggataagcgtccgccttatctgccaggccaatgcgctccaacagcccgatcgcacgcttatcagcctcctcctgcgtcatcattttaagccggacgggcgcgagcgtgatattttcacgcacagacaggtgcgcgaacagattaaactgctggaacaccatgcccatcttgcggcgcaggcggttgatatcgcactttttgtcacagatattggttccttcaaaccagatttcgccgccggttggctcctctaggcgattaaggcaacgcagaaacgtcgatttaccagagcctgacggcccgacaatcactaccttttcacccttttcaatcgtctcattgatccccttgagcacctcgacgcccttgaaggatttttgcagatttttaacctcgatcactgcgcgccatcctcctctcaagccgtgcaaacagggccgaaagccccagcgtcatacacaggtaaatcaccgcggctgtcaacagcgggacccatgcattaaaggttgcgttgcggatctggtcggtcgcctttgtcaaatcgaccagcgcaatatagcttgcaacggccgtctccttgatcaagacgacaaattcgttggtataggtgggcagaaccgctttaaacgcctgcggcaaaatgatcagcttcatagtctgcgcgccgctcaagccgagcgaccgtccagcctccacctgaccgaccggcacgccctgaatacccgaacggaaaatttccgcgcagtaagcgccggaattcacgccaaagctgataattgcaaccaccagcttcggaacattcgtcggcgcaaaaaagataaagtaaaaaatcataagctgcgtcaccatcgggatgccgcggatcaccgtgatatacagtgtagaaatcccccgcaggagcctgctgcgtgaaatacgcatcagcgcgaggacagcgccgattagcgtcccgatgacaatcgcgccgagcgcgatgcagattgtggtgcccagaccgcttaaaatcagtttccagcggtctaaggcgatcaggttttgatagagtgcatccatagctgtacgacccctccggatattaagcagggcggggctgacgccccgcccacaacttttcttgtatatttacttcttgagaatgatgacttgctttgaagaataatacgggtcggagaaatcgacgctctggcggcgctcctcggtagctgtcatacctgccgcaacaaagtcaatcgcccctgcgtcaagcgcagaaatcaggctgtcaaacgccatatcctcgacctgaagcttggcgcccatgtcctgcgcgatctgctgcgccatagaaatgtcaaagccgacaacctctgtgccctctacatattcaaacggcttgaaagcggcgtttgtacccattttaatcgtcttgtcgccttctgtcccgacagcatcggggattttgatctcgctgtctccgcctgccggcatgaacgcattcacaagggattcgtaggtgccgtcctcctgcatacgtgcaattgtggcattgatcgcttcaagcagttccgtatttccttttttaacggcaatcgcatactcctcggttgcaagatccgcatcgaggatcatcagatcgtcgttctgcgcgacgatcgatttagctggcagctcgtcgagcacaacggcgtcaatcttaccgttctttaggtcgagcgcggcgtccattccagatttatagctgccaagctcggcatccgcaacattctcctgcacatatacctcgccggtggtaccagcctgcacgccgatctttttgcccgccaggtcagccgccgacgtgatcgcgccctccgccggggcagaagcagcttctgaattcgcggctgtggaaccagcggcggatgacgcgggcgccgccggctggctggagcttgcgccgccggaagaaccgcaagccgccaatgacgcggccatcatcgccgcaaggatgactgacaatatctttttcatttttatttcctcccaatcaggccggctggccggccgtatgctacaaacgtataatgtttgtatattgatttataattatacatattcaaccacttaatgcaagcgtttttaccaagaaatattcacacaaatttatttttatgcacatttactatgtttactgattgagcggtatcaacttttgcatatcttttggaatgggagcgcgcacaatgcaaagccgcttgtctaccggatggataaaagatgcctgcatacaatgcagcgcctgacgctctatccgctccgtctcaccgccataaagcgtgtcgccaagcagtggacatccgattgatgccatatgcacccgaatctgatgtgtccgtcccgttcgcagtacacaatgtacaacgctgtacccctcacaacgtatctgtgtctcatactctgtaacggccggcttaccgttcgccacaatcatacgccgcgggttctttcgatcgggctgtccgatcggcgcgtcaatcacaccatgttttggatttggcataccggttacaagcgcgatatattgtttctcaacatgtcccataagcactgccgccgcgcgcgcattcttcgcaattacaaccgctccgcttgtatcgcggtcgagccgtcccacaagccggcaggcacagctctctccgtttgcggcgcagtcgcgcgcaaacacattagccagcgtcccctgacgcagaccgcgcacaggatggcaagccatggctgcaggtttattatatacgatcacatcgctgtcctcgtacaggatttcaacgggtatttcgcaaggctcaaaggtttgtggagcgtcacagatcgtaatggaaaggcagtcgccggtatgtagccggtcgattgtacggatgcgtgttccgttgagcagaatgccatcctcaaacgttttgagcgagcgcactaaagtataagagcattgcgcaggtccgcgcaaaaagtgaatcgcctttcggccatcatattcgggtgggatcacaaaatcgagccggcgtttacccatacaagccattccccttcccccaaacgccaaagcacgcagccgtggttaaaccgcggctgcgtgctttgcacaaagagcttacttgtccatgccgaaacgctttttgaacctgtcgacacgcccgccagaatcaaccagtttctgacggccggtgaagaacggatggcatttcgaacaaatttcaacacggatgttttcctttgtcgaacgtgtatggatcacctcgccgcaggcgcatgtgatcgtcgtatccacatacttgggatggatgccctctttcatttgtttcacctctttctggtatcggctctagataccataaatgtaacatttaaatgttaccacagtgcgtcccaaattacaaggctttttttaaatatttttgtcttttgaaaattgtaatattaattgcgaaaggaaagcgcgacgaaaagcgcggccgcctcacgcgctgcgaggtcatactgcttgctcaggctcacaaactgttcccccgctccgctggtaatccggcgcagcagcaccatgcggtcgcttccctgatccctgaggaagctgtcaaacgcctgtttattagccctcgtccgtaagttttccaagtgctcgctcgccgtcaggaaggtgcgcgccttcaaaaagagcgtgtcgatcggttcacgaaactgcctgtttatccggcggtgcttcccacagcgcgcctcaatctcaagcattgcatccatcatctcgttatagagcgcaaccacctttccaccgctccgacagcggacgaacccttgggatccgcatcctctgtcggaacgcacccgcaggaataggcgtccgagacaggactgatccgcaccgcttcaacggtgcggatttttgtagcccaaaagctatttcaaaccactctcccgctgccctgagtctgcggcatcccgttcgctgcgccagaaagcaactcccacacatatgagcaccagaagatttgctagccagatcccccaattatagaccgcaaccgaccggaccaggttgaccaaaactgtcggaatcacaacaacgtaataaatcggactgagcagccgggaggatttccccgtcttgtccgtaatggcagcgttcaccaaaaacgccaacagaataaataccgccccggctaaaatcccagcagatttcaagcttttttgaagcagttcagacgggagattttccgcctagacgtgtgcgcctccctttggtacagcttcccatatgcaatcattttctttttgatctattaaacgcccataattttcttgacatctgttccaatagccgccgcgcgcgcatcaatttcccccatatccttgccgaccgccgaaagatacagcttaatcttcggctctgtgccggatgggcggacgatcgctgtgcagccgttggcgagcgcatactcaagcacatttgatttcggcagcgaaatcggacgtgtttcttcggctgaaacgaccgtggacgcttcataatcgctcgttgaaacaacatcgctgccgccgagctgcttgggcggatgagcacgcaggccgtccataatggccgccattttcttcataccctccgcgccctcaaactggaaatttgcaacgctctcgcaatataacccaaaccgcttatataaatcattgagcgcgtcaaccaaggtcatgcccttttgcttataccaagacgccatctcgacaatcagcattgaaccgacaaccgcatccttatcgcgcacataggtaccgctcaaatagccatagctctcctcaaagccaaaaataaaccgctcaggatggccctgcgcctccacaatcgcgatctgctcgccgatatacttaaagcctgtcaacacgttgatcacttcaacaccatacgcttttccgatggcgtttgtcagctttgttgaaacgatcgtcgtcactgcaatcggatcctttggcattgtgccgttttctatgcggttgcggcagatataatcaaacagcaacgcgccgacatggtttccggtcagcaacctgtaatcatcgccgtccttaaccgcgatacccacacggtcgcaatcaggatcggtcgcaagcatgagatccgctccagtctcccgcgcgagcgcaagccctttggccaatgcctccttaatctcaggattcggaaagggacaggtcgggaaattgccgtccggatgttcctgctccgctacaactgtgacatccgatgcgccaatttcacgtagcacacggcgtaccggctgattacccgcgccattcagaggagaatacacaagcttcaggccggctttcgcgcagatgcccggattgacctgctgagaaaggacattttcaatgaattgatcgatgatcgtctgtgcaatgtattcaattttcccatcgtggattccctgctcaaaatccagcgtcctgatatcgtcaaacaaatcaaggctgttgatctgcgcaagcaccgcgtccgcggcattttctgtcatctggcagccatcgcagccgtatactttataaccgttatattttgcggggttatgcgacgccgtgaccataatgcccgcgtcgcatttgagcgcacgcgtggcaaatgacagcgccgggacaggcatcaattcacgatagatataaacgtgaatcccgttcgcggccaacacgcccgcagcctctttggaaaaacggtcggatttgatgcggctgtcatatgaaatggcgacggttgggtgctttgcctgcgcgttgagataattggccagtccctgtgtcgcgcggcggactgtataaatattcatccgattggtacccgcgccaagcacgccgcgcaggccggctgtcccaaaagacagatcccggtaaaaccgatcaaaaatttcgtcgtcctttcccttgatcgcctcaagctcggcgatcaggtctgcatcctcaagcgaatgcgacagccaacggtcatacaactgcatatggttcatattgcgccctcctataacataatgataatattaaaaagcaagctctttatgttttcttatttatatgataaccatcccgaaggacaaagtcaattgcccgtatgacaatatctggtggaaaacggaaaatctttcatgggatgccttgcgtcatgtccattaaagtgctatacttggcagagtttcgctaaaaagccgacaaagccggaaggtcattacaaaataaaggggtctttaaccgcatgactacactcacgctctttatgatcgctttgggactctccatggacgcatttgccgtctccatttccaacggcatgtgttaccgtggctttggccggaagcaggcgtttgcggcggccgctgcctttggcctgttccagatgctcatgccgatcgccggatattttgccgggcgcactttcagcgaggcaatcggatttgccgaccattggattgcgctgtttctgcttgggatcatcggcggtaaaatgattgtcgacggcgcgcgcgaactgcgccatccagaaagctgtgacagcgcagccggcgcttttaccctgcgtattctcgttctccaggcggtcgccaccagcatagacgccctcgctgttggcgtcggcttcgccgtcatgcaggtcaatatcgttaccgccgcggcctttatcggtctgattaccttcgcctgttgtatcattggcgctatgcttggccaccgttttggactgctgctcggaacacgcgccgaaatttgcggcggcatcattctggctggtatcgggctgaaaatttttacagagcatatgtttggaatttaaaaatttaagacatccggttgataagatttcagcagcaggcagattctccttctaaggctcccttaagaatgagaatctgcttttttaaaaggttttttattctatattcgacaaaatattgctttttttgtcaatcagaagtataattttaccagaatataatctggagggatcgccgtgctttcaaccgttcaaagtctcggcctgctggggatcgagcctttttctgtcactgtagaggttaatgtggcgcgtgctatacccgcttttgaaattgtcggcctgccggacgcagcggtgcgcgaatcacgagaacgcgtccgttccgcatttctaaactgcggctacccatttccggatggacgcatcacagtcaatctggccccggcggacgttaaaaaaagcggctcgctccatgatcttccgattttgattggactgctttgcgcacagggcacgcttccagaactgcccaaagcctctgcgtttatcggcgagctttccctctcaggcgagctgcggcgtgtttgcggcgtcttaccgatgctgctcggcgcacaggagcttggcgtcaagcgtgcttttgtaccagcgcctaacgccgcagaggcgtccgtcgtgcatggtcttgaggtctatgtggttgaaaacgtgcgtgcacttgtcgattttctgcgcggagaaggcacgcttttgcgggctgaaagcgccaaaaccaatcaaccccaccgctgctcagtacccgatttctgtgaggttaaggggcagccattcgccaagcgcgcgctcgaaattgcagcggcgggcggccacaacacgctcctgatcggcgcgcccggcaccggaaaaagtatgctggcccgccgcctgctctccattcttccaggaatgacggaggcggaatcaattgagacgaccaaaatttattcagccgccggtcttctggagccggggatcccattgatcacagagaggccgttccgcgctcctcaccatactgtctctcccgccggtctgtgcggcggcggttccattccacgtcccggtgaaatttcgctggcacataacggcgttctgtttcttgacgagctgcctgaattccagcggccggcaatggaggctctgcggcagccgatcgaggaagggagcgtgaccatttcacgcgtcaacgcccggctgcgttatccgagtcggttcatgctgaccgctgccatgaatccgtgcccctgcggttattttggccatccaaccaaacaatgcacctgttcgccggcgcgcgcttcagcctatctgaacagcatcagcggtccgcttttgagccgtatcgatctgcatgttgaagttcctccggtcagctatgagcagctttcggccattggcggcgaggagacatccgccaatgtaagggcgcgtgttgtagccgcacgcgccattcagacaaatcgtttcgcctgtaccggtattgcctgcaacgcacagatcccgcctgctctgcttgccgaatcctgcccgctcgacagcggagccgagaagcttctgcgcggtgcgttcgaccggatgggactgtccggccgggcatacgaccgtattctcaaggtcgcacgtaccatcgcagatctcgatgccagcgaacagatccgcgcgccgcatcttgcggaagcactgcaataccgcgcgctcgaccgtaaatactggaaccggggctagagaccggcttttccgggtctggaaagagcgcctctcccatctccttcataatgcctgcctgcgggataccgatacaagacgttttttaccgattgtctatgtacaagctctcatcaatcatgtataatataatataaatctttttgtcggattttggaggctggcaaaacagatccgtcatgtgggagcgtaatagctcgcacaggcagcgattgaaaaggagcgtaagcaatggcaggacagatcgatacggaagatatttttagggaatgcggccatgtcgccgaattggggctgattgttacagaaggcgcgcgacagcttggtgagaaaatcaacgaacatcttgtcaggtgggcgtcgggcagcccttgccaaaaagatacctttattattgaaagcgaatgccctcgtttctcatcaggcgacggcaagggacttatcaaatcgaccgtccgcggcgatgacctctattttattgttgacgttggtaattatagctgtacctataatatgtttgggcagaaaaatgcgatgtcgccagacgaccattttcaagatctgaaacgtctgattcaggccgccagcggcaaggcgcaccgtatcagcgtcatcatgcctgtgctgtatggcagcaggcagcacaggcgcagctaccgcgagtcgcttgattgcgctgtggcgcttcaggagcttcaaaatatgggggtttccaatattatcacctttgatgcgcacgatccgcgtgtgcagaatgctgtccccttgatgggctttgacaatgtttcaccttcctaccaggttctcaaggcgcttttgcgcagcgtccctgatatccggctggaccgtgaccacctgatggttgtcagcccggacgaaggcgctatgagccgtaatatgtattatgcctcggtgcttggaattgatctcgggatgttttataaacgccgtgattatgcgcgtgtcgtcaacggccgaaatccaattgtcgcgcacgaatatctgggcgattctgtcgaaggcaaagatgtttttatcgctgacgatatcatttcttcgggcgaatcaatgctggaggttgcgcgcgaactgaaaaaacgcaaggctaaccgtatttttgcttatgccacctacgcaatttttacaaacggcgttgatgaatttgaagcggcctatcgcgacggtacaattgcaggcgtctttgggacaaatctcacttatcgttctccaaaattgctcaactgcgaatggttccacgaagtggatgtctccaagtatatcgcctattttatcgccgccatcaatcatgatatgtcggttggagcgattatcgatccacatgaaaaaatcaggcagcttctcgccaggcgcgcaagttgtgtcattggttaaaattttcaatttcaaattaaaacctctatccacaatcgttgaacgctgtccaggcaggtcttttgcacctgctttgccttaaatttttttgttgggtgacagttcgccttgcaaaagtctgccttgaccgggtatccacattgcttgtccagcattctccggcgatgaatacatgttctaaaagggaagtcctaaaaataggattcaaattatatccatttttatggggcatggcgcggccgaagctgcaccatgtcctattctgctttcaaagcaaaatggggcttgacaagcatttttttatctggtaatatatcactactttatcggagggcttataatcgtaagtataaggccggataagatagcgaatatacggtttaacggagggcgcctcttacgtataagggcgctggataagaaaaccgcttatgttcgttttcttatccggctttttttatgtctaaggaggaaaatcaatggttttattaaggagcaatattaaaccaatctattttaagtatttatccgccgcattcggaagcgcaatgattacatctgtgtattccattgtggatatggcaatggtaggacaataccaagggccgagtgggacggcggcgctggcggtcgttgcgcctatatggaatatcatttatagccttggtctgttgatgggaaccggcggctctgttattttcagcacgctccgaggaacgtccacacagaaaacggaaaatgaaaacgaatattttacaacagcaataattggttccattgtactttccgtgattgtatggctcgctgtcattttttttgaccagccaatattcgtattttttggtgcagataccgaattgctttcattggcacaagcttatctggcaccaattaaggtggttatcccattatttttattcaatcaaatgttagcggcttttttacgaaatgataaccatcctgaacttgcaaccataggtgttttagcaggcggactttttaatatttttggcgattatgcttttgtttttttgcttgatatggggatattcggtgccggacttgcgaccgctattggttccgctatttcatttgtcgttatgctttcacatttctggtccaagaaaaatacgcttgttttacaaaagcctgtcgatattgtttataaattaaagcaagttattattactggattttctacgttttttattgatattgcaatggggattttaacagttctattcaaccggcaaattatgaaatatttggggacaagcgccctagccatttatgggccaatcgtaaatgtaagcacgtttgtccagtgctgcgcttacagtgttgggcaggctgcacagccaattatttcgattaattacggtgccaggaagtggaatcggataaaagaaactctgcgctatgctctttatacagtcgtcttcttcagtattttctggacagttcttagcttaatctgccccaatctgtatatttacatttttatgaaaccgacagcagctatcctgcaaattgcgcctgctattattcgttcgtacagtatttcattcattctattgccgttaaatatcttttcaacctattattttcaagctttaatgaagcccaagaccgctttcactgtatctgtttccagaggctttatcgtcagcggcattttgattatgctgctccctgttcttgccggagcggattccgtttggtttgccatgccaataactgaattactggtggcgatctatgcggtatatatgatcttcaaatatacgaaagcgatgtcaaatgagggacagtcaattataatttcagatacttaattaagaaaaaagacgggcgagaagcctttgcttctcgcccgtcttttttattttacagcaatcaattcatattgtgtactgccgatccctaatttttcggcgtgctcaggtccgacacgccaatcggtcgccggatgaagctccttaaaatggtccccgccagccgggcggccttcaagcagactaccaggcagcgccggatgcccgtttactgcgtcggcacaggccatgtcaagcgccaccggatcaaaggaggcgaacattccaatatcctgtacaatcggcaaatcattttccggatggcagtcgcaaaacggcgaaacagacatcaccagacagatgtggaagtgcgggcgatccttgaccacagccagcgtatattcagaaatctttttattgaggatatcaaacgcttcatcctgagccgcttgtacagcgtccacaggacaggcgccaatgcagcggccgcagccgacacattttgagtgatcgatcgaggctttacggtttgtaatggcaatcgcatcatgcgcacaatttcttttacacataccgcaacccacgcaaaccgattgctcaacatatggtttgcccgcggaatgcatctccattttgccagcgcgtgaaccgcagcccatgcccagatttttcagcgcgccgccgatcccggtacattcatgcgccttgaaatgtgtcagcgaaatgatgatatccgcatccataatcgtgcggccgatcttggcttccttaacatattcgccatcaaccggcacaagctgttcatcggtcccttttaatccatcgccaataatcacctggcaaccagtcgaaaacgggctatatccgttttcataagctgcttcaatatgatcaatcgcattcttacgccggccgacatacagcgtattacagtcggtcaggaagggccgaccgcctttttccttgaccaagtcagctacaaccttggaaaaattcggacgcagaaacgcgaggttgcccggttccccgaaatgaattttaatcgccgcaaacttattcttaaaatcgatcgtctccatccctgccgcgcggatcaaacggtccagctttttgagaaggccgtcctccaaacgcacacgcaaatctgtaaaataaacctttgatttatccgccataatactcctcctgccagtgtttctttgaccgcgctccgcccgccggcacagcagcgcgatattcattccaatgctttttgcatggagcgtcaaagacaacatcattcatcacctatattataccatccacttcaaaatctgcaacgtttcaaaggaatttgttttctttattcttgaaatacatataacctttgtcaaattgtgattgaaatttatatggtttgactgttgaaaaacaattggtatcggactatactaagacactggaacgaattattagaacgtggcggcgacgcaagtccgccacaggaaccagcttcagtcgttcatgctgcgtcggacatcgcaattgccgcaaatgaagcgtaataaggaggagcatcagaaatatcacggcgcagacggacaagattgaagtatggatccgaggaggtaatttttatggaatcttacagctttctgatgacagttgccatcattcttctcagcacaaagcttctcggtcttctgacaaaacgcatcgccatgccgcaggtcgtcggcgctctgcttgctggcttgatacttggtcctgcttgtctcggcgtgattcatgagacaacctttcttgatcaaatcgccgaaatcggcgtaattgtactaatgtttaccgctggccttgaaacagatatcggtgaactcaaacgttccggcaaggcgtcttttctgatcgccttaatcggtgttattgtaccgctggcaggcgggtttgtcatcgcttccatcttcaacacgcaatcagatgcatttttacaaaatgtctttatcggcgtcatcctgacagctacctctgtcagcatcactgtggaaacgctcaaggaaatgggaaagctatcgactcgttccggcaacgcgattcttggagcggcattgatcgacgatatcctcggtattattgccctgacgctgatcaccagctttgcagacccaagcgttaaaatcggcatcgtcctgattaaaatcgcggcatttttcgttctgagcctgatcgctggcattgtcatgcataagctgatcgaatattggatgagccgtgcgcctggcgacctgcgccgctacgctgtactttctttcgctttctgcctgatctttgcctatgtcgccgaagaattctttggcgttgccgatatcacaggcgcctacatagcgggcttgatcatttccaacaccaaaaaggtcacctatgtagcttcgcggtttgaaatcgcttcgtatatgctgctctctccgattttctttgccagcatcggcgcaaaggtcgaggttccgccaatgacaacctccatcatcctgttttcgatttttcttgttctgtgggcctgtatttccaaagttcttggctgcggcttgggcgcaaagctctgccgctattccaacagtgaatgcattcaaatcggcattggaatgatctcccgcggcgaagtcgccttgattgttgcaaccaagggtatttccaccggactgatgcaggcagacttttttggcccagttgtaattatggttattgtgacaacaatcatcacaccaatccttctgaagctggtttaccgcgacaggaaagaggattacagcgatcttgtccagagtaaactcgtcgatcagtatgaggaagtgagagatttcgacttggcgtctcaaagtatcctggatttacatcaaaatattgccaaacaggctgaggaaaagaagcctcaaacgaaatagtactcaaaagtgtccgattcaaatcggacacttttttgtaaataatccaggatttacacggttgcattcacctgatccgcatatgatatagcggaggtgattttcatgtatcttgaacaatccaactatttttcctatggattcggctgtgatatgtcggcggccaattattttgactcccttccggaagacgtcaaacgagccatcaataagcggcctgaggaatttcattcagtggcagagctgcgccgctatgccgaagcaataaaaaagaaaaaaaatatgtaaaattcgaaaaaacatccggtgtcacgtccgttaaatcagctctgacaccggatgtttcaaaccccatggatcagcgatactgctgccggtcctggtcctcccaatttgattctgaacccgcctgctgccctccctgttggaagccatgaacgccggggctattgatattatgcgaccaattgcgcccaccctgtatatatggctgtggttgcggcggtgggatataccgttgagggcgtccattgttattatagttattaccaggcaaccaattcagctccttctctacatttttctatgcaaacgcatagcaaaacggccctacgccgtttttgacggcacagcccggaatcaaagcgcgtgggccgggacggcccgcatacgcaaaaactacttcatgcgccgctatttttgcctatgactgcggcgcgcacacagcgcatgaagtatattataccatgtccgcgaagcggcatggtataatcgaccatcggggcgaaagcgggccgtgcccgcgtatcgccttggccataagattggtataatagccgctctgcggttattataccacagcaacaagcccgatggacttgcctgccgtcattcagcgtcagcaaacggctttgccgtttgcactgcgcaattatgccatgtctgccagttggcatggcatattctattctattcgggaaagaacgaatcggaccttataaacgaaggagcagggcggacaccctgctcctttgtttataacctgtattcacagtcaccaagcgccgtgcaggctggccttttgctccagtcctgcgctgagaagctgtaccaatgggtaaacgcacatgtccaggcggaaaattttctcgctgctccatgcactttccccattggtacagcttctgaattttttgccgggcgacaacccgcctgcaaaaattttccttgatcgggtacaagactcctcgcctgccctgcatcttccggctgtaaatacaggtacttaattctgtctgagagatgtcaaaaaagtagaaaaatagtccggcagctcgcttgaaaactccatatatacaccagtacgcggatgatgaaatccaatgacccttgcgtgcaggcactgtccatgcaggcttgtgatggtcttctgcgggccgtagataggatcgcccgcgaccggatgaccgatatatgccatatgcacacgaatttgatgcgtccggcctgtttccaggcacagtttcaaccacgtgaaacgccccagacgctccagcactcggtaatgcgtcaccgcaccacgtgcgtttctgtctgttacgcacatcttcttgcggtcattctggcttcgtccgatcggcgcatcgacggtcccttcatctgttgaaaaaccaccgtacactaccgcgttataaatacgtgtaaagctgtggttcttgatctgttccgccagcgtgccatgcgccgcatcgtttttcgccacaatcaaaagaccgcttgtatccttatcgatgcggtgcacaattccaggccggatcactccattgatcgacgaaaggcggccttgacaatgatacagcagcgcatttaccagcgtcccgttcggatgtcccggcgcgggatgcaccaccattcccttcggcttgttgacgacaagcagatcgccgtcctcatatacaatctcaatcgggatgtcctgcggtacaatgtcaagcggctgcgcatccggcacatcaattataaacgtctccccgccgcgcaggcggtcattctttgaaacaggcttttccccgacccgcacggctttgcagtcacacagcttttgaatagctgaccgtgtaagcagcccctcagcggcgctggccagccagcggtcggcgcgaacgccggcatcagattcctcggatgtatagtacagcctattcatcgctgtccccgcttgcctgtgtcccattgggtttctttcgtccatcgatcagaagcatataaaccgccagcatcgctgtaccgattacaacgcagcaatccgcaaaattaaaaaccgggaaactgaacagcggtgatatatcgatataatcgaccacaaacgatcgaaaaacacggtcgatcaggttgccaacacctcccgcgataatcagcccgacgctccacatcaaaagcggatggcgcagccttccgcgtatgagcaaaatcaatgcaacgacaatcacagccagggtaaacagcgacaaaagcccgacgcgcccttgaaaaattccaaaagccgcgccgcggttctccacatacgtaaattgaagcagcccaggaatcaccaggattgacgggccgccggccagcgtttgcagcgcccataccttcagaagctgatcgacagcgaccaaaaacgctgaaacagccagcacgataccaatgatcatatagaaaccacctattccgataaaaaactgcggcgcttaaaccttcattaagcgccgcagacaattgtgtctattagccgatgatctgtgcgcagcgggcgcaaagcgtcggatgccgcgcatccttgccgactgtatcgctgtacacccagcagcgcgggcaatgcgctccgtcagcatgcgcaatctcaattgtaagaccgggcaggaacggaaccgtcccctgatatgagccagccccttccgctgtaacctccacctgggaaacgatgaacacggttgccagctcatccaatgtcagaccgatctgctccgcaaggctgccgtcaaagtgcagcactaccttcgcctcgagcgatttaccgattgttttggcattacgggcagcctcaagcgccttaagcacatcgtcgcgcaaagcgtgaatacgatcccacttctccataaacgcctcatctgaaatgccctcaatgaccctgggcatctcattgaacatcacagatgcaccatcatagcggctgtcgtcaggcataaagctccaaatttcctccgccgtaaatgggatgatcggagcaaacagcagcgtcataccgcgcaggattgtgtagattgtgctctgcgccgcacggcggtcctctgaatcaggggcctcgacatacaggcggtccttgatcacgtcaagatagaagttggacatatcaatcgtacagaaattgtggagcgcatgataaatgatgtggaattcaaagcggtcatacgcctctgtaaccgtcttgacaagttcattgaaacgtgtgagcgcccatctgtcaagcccggtcagccggtcaaaggcaacagcatctttatcgggcgtaaagtcggcgatattccccaggatataacgcgcggtattgcggattttgcgatacacctcggaaagctgcttgaggatgtccttcgaaatacggatatccgcatgataatcggctgaagcaacccacaggcgcaggatatccgcgccatactgatcggtgatttcagaaggttccattccgttgccaaggctcttggacatcttgcgcccctcgccgtcgacaacccatccatgcgtgcagaccgtcttatacggcgcgacgcccttccatgcgaccgaagtcagcagggatgactggaaccatccgcggtattggtcggtgccttcaagatagaggtcggccggccacttcaaatcgggattgtcgtggataacggacgcataggatgttccggaatcgaaccaaacatccataatgtctgtttccttaacaaattccgtacagccgcaggcggcgcattttgtgccggcgggcagaatatccgccgcgtcggtcgtataccaggcgtcggaacctttttccctgaacagggccgcgacagcctcaatgcttgtttcatttacatgatattttccgcattgcttacagtagaaaatcggaatcggcacgccccaggtacgctgacgcgaaatacaccaatcgctgcggtcacgcaccatattgatcatgcggccgcggccccattcaggaacaaacgcaaccttttcgatctcggacacagtctgttccttgatatcgtcgacggaacaaaaccactgctctgtcgcgcggtagatgatcgggtccttacagcgccagcaatgcggatactggtggacgattttctcaatggcaaacaggttcccggtagaagccagcttcttgacgatcgcagcattcgcatcgtccgtcgaaagaccggcaaattctccggccagttcggtcagattgccaaatttatcgaccggtacgacgacctcaatctctggataatgctgcgcgcagacatcaaagtcctcaacaccgtgtccaggcgcggtatggacgcagccggtgccgctctccaacgtgacatggtcgccaagaatgacaggcgactgccggtcaaggaacggatgctggtaggtgatgtattccagctcctccccgagacaagtgcccaggatttcgtaatctgcaattccggcagccttcatcgaagccccgacaagctccttggccattacataatattcgctgtttgcagcgacgacacaatattcaaatgccggcccgacacagatagccatattgcctggcaaagtccaagtcgtcgtcgtccagatgacaacaaacgttttagaaagatccttcgcgccgaggcgctccaaaacaccatccttgtcgtcgatcacattgaacttgacatagatggaattgcacttgtcctcattgtactcgatttccgcctcggccagcgccgtttcgcaggtcgggcaccagtatacaggctttaatcccttataaatataacccttgttggccatcgctccaaaaatttcaacctgccgcgcctcgtattccggcttgagcgtcagataagggtgctcataatcggcaatggtgccgaggcgtttgaactgctccttctggttctcgacgaagcgcagcgcaaaatcatggcagacccggcgcagctcaatcggggcgatgtcgctggaaactccgatctccttgagcgccttgagctcaatcggaaggccatgcgtatcccaccccggcgtatatggcgctttaaagccggagagattcttctggcggacaatgatatccttgagcaccttgttcagcgccgtgccaagatgaatattggcgtttgcatacggcgggccatcgtggaacatgtaaagcggcttgccttcgtttttctcaagcatccgctcatacagatgttcttcatcccattttttcaccatgacgggttccttctggggaagcccagcgcgcattgaaaaatcagtttttggcaggttaagcgtcttgctgtaatccatttcggacattggacagatctctccttgtttgtctattgtcatcggtcacgccggatatgcagaccaagctgtgttctcagcgtctacgctttccgtcgtttcgtttcaggtcaaattcacggccaaatttcagcggcccaaagcgagattcatgcttggccggctcgtccggctcgccgtcgggaatatattcctccgtctcctcgtaccggaagctttcctcctcgctgtaggtcagagggggcagttcatcttccgccagcggataaccgtcctcctccacaggaaggccggccaggccgtccggactctccggcagatccgccggagaatcgccggcatcctccggaactgtctgctcgggcatggggtcagacggctcgtccggccctgtgggcgtctccggcgccggcggtttgggctgtgtttttttcattgcggcgttcacaatgttttcatcgaccggaatggacgcgatcagttcaagatgctgcttatacacaagctgaagcttgcttttgaacgtcgcgacctcccgctgcatccgcacaaagcccgcctgctggcgctcgatttcctgtttggcgttttccacaatcatgttagcgcgcgcctcggcgtcctccagaatatcccttgcctttgccttggcgtcacgaacgacgctgtcgcccagcttctgcgcgccaagcagtgcggagcgcaggctttcctcgtcatccttatattcttccagcttgtccgccagaacaatcagctttttttccagctcctgcttttcttccagaaggtcgttcatgctgtcggcaacctgagcaaggtaattgtccacatcgtccgcgcgatatttctgccccattactttgtcaaatcttttattggcaatctcgtttggattcagcacgatcaaacatcctccttatctattggaacggttcgtcaaacgaacccgatcagacatattttctgcaaaggatatgcaggcggccctttttcgttgacgacaatacctgcttgaacaggtatttcccatacccccgaatgctgaaaacatcgccttcacagagcataccagacgtttgcgccagcacggcgccgttgacagctaccaactgcgaacggattgcctgcgccgccttttcccgggaaagcccagcgacggcagccaccatgcaatcaagccgcagcgacgtaacgatcagcggcagatccgcatacctgtgcaacgcgggcagaacctccggcattccttcacacacacgcacgccgcagcgccctgcctttttcagttcatttaagatcaccggcgcaactgcggatgaaacaaagcaaacggcgtattccccgcctaccagaatgtcgccgatcgcctcacgcccaattgcaagccctgtgagcgagccgagcaggtcgcggtgccccggcgcgtcctgcgcacggtatccgatggtcagcgggacaattggaaacgaagtttcgtccggctgttcatacggtgcgaacgcgccgagcatcacacgctccgcacccggatagccgccgaaaaacaaatgctccgcgccgcttcccgcggcggatacgcatccgcgcgccagcacaagctggcgcgcgtcgagaaatccggagaatcgcgccgtatagcttttgcgggcaatctccaagaggtcacagatatgcgcggcgaatgcctgctccttcttatccgccaaagccatcagaagaatacgccgctgctttcaagctcgtcaagcagatcgcccataatatcaacattatacggtgtgataatgtaggtactgtttgcaacacgcttgatctgtccgttatttgcatatgcgacgcccgataaaaaatcgatcagacgccgtgaaacatccttgttggtcgattcaagattcaacacgaccgtgcgcttgtcgttgagatgatcggcaacggcggaggcgtcctcgaaccgctccggcttgacaagcacgacctgcagctgtgtggtcgcatggatattaaccaccttgttcccgcgtttttcggaatgggacggcgggtcctcgcgcatatctccgcggccattgtcgctggagataaagtcgacgtcctcgtcgtcataatactcatcctccgggatcccgataaagttcttgaatttatccatgattcccactgaaacaaccccctctgattcacttggccgggccataatccctatgcccgaacagcctggtgccaagacggaccaggttggaaccgtgcttgattgccagcagatagtcgtcggacatgcccatagacaaaaaatccatattgatattatctaattttttgtccctaatgtcaacaaatagtttatgcatgccggaaaaataacgctctttttcagcgtccgtaccgctcacaggcgggatcgccatcagtccgcgcacacaaatccgtccaaaaccggatagttctcccagaaaatcagacaatcggtcgggagcaacacctgattttgacaattcacttccaatatttacttccaccagacaattcatttttttgtcgtgcttttcgcattgacgctcaatctcctgcgcgagcgccacactgtcgagcgattggatcatcgtaactttatcgacaatctgacggaccttgtttgtttgcagatgtccgatgaaatgaatgtccacgccgtctttttcataatcatcatacttggccagcagttcctgcgcccgattttcaccaagcaaccgcacgccggcatggatggcctcattcacacgctgcgcctcaactgtttttgtcacggccatcaactgcacatccgaagcgtcgcgaccacataatgcacatgtttttgcaatattatccagaatttgttcaaccgactgcgcaatgctgagattatttaagcggttttccatcatataactgcgccccctcaataatgacttcgtcaaactgctgcaatccattcgcgccttccggggtgttcgtgtccatttcaagacagattacaaaccccggcgattcatacaggattgtaaccggccgaaactgcatcgtttctccgcgtgaaacatagacgcccttctggattccttcgtaacggatcgccgaactgcttatacgcagcccggaaatcgatttaaattccacatcagcttgtgtaaagcgcagattgacaagcgattcattgatataatcgcagcggaaaatcaccgctgcgccgccattgtccttatcctcattgacgctgtacacaactgccggaaccggctgtgtccccgacaaatggaaatccagcgtgacagaagcgccttccttataaagcgacacatcctcctcgggaaccgtaacggcgtagtaccagcggtggccaagcatcaccttgcccacgcggtctgattcaccctgtaccggctgtgcgagcagctcgtcgacctgcgcccgtgtcagatcggggacctccttatagggcactttcccctcaaagccgtcaatggtccgtataaaatagccgggctgcggcgcggtaatctgccgcgggtcgcggctgatctgattggacagatagctttcctcggccttgagctggttgatcgtttcctgaaaatctgactgccgtcccgttgcaatctgtttggtgttcataagcaacaacaggttgtccgcgttttcagctgccccagccatcgatcccgattccacagagccaatgattgtatccagctcgctgaaaatctgccggttaagcacatccgtatgcgcaaacgacgtggtgcccgggtcctgcgctttctcgagctgcgtgcgctttttttcaagcgcgcgcagctgttcaatattccgggcgtcctccttattgcggtagatctcagcgattacggtcccgcccgcaacctttgcaccgtcacccacaagataggaggcaactccgtttccaacactgttatcgagcagaacctcgtcgcgcagaacgacgccgtttacgctcgctgtctccgtaaccgtataagtaaacgccgtttccgttttataagcaggcgtcacatagcgccagatctgatatcccacatacgccagcaggaataccgtcaccagcgccatgacaagccgctgcgtcagcgtacttttcataatttaccgttattcttcatcctggtcgtcctcagccgtttccaagatgctgatcaccttggacggactgatcgtggaaattgcgtgcttataaacaaggttctgtcttccttcgcaatcgaggatgactgtataggaatcaaacccgcgcacaatccccttgaactgaaacccattggtcaggtaaatcgtcactgtgagcttttcacggcgggcttgattaagaaaaacatcctgtaaattgagctgcttcatacttacctccctgctgcggcgcagcatcggaccgcttggctctgctgccaagactgcccattcaccttttttacaatatctaattatatcacagaattccgctcttgtgaaccacacaaaccgccttttcggttaattcccgcagcgattcacttttatcaaccatcagccagacgatacgcgcatcgcgccggaaccacgaaagctgccgctttgcgtagcgccgtgtcgattgcttgaggcggtttatgcattcctccagcggcgcgcctgcgtccagatacgggatcagttccttgtaaccgattgcctggagtgccgtcccgcggcacacggcgctgactgcgcgcgcctcgtcgatcaggccgcgctcaatcatcaggtcgacacgccggttgacacggtcatacagcatcgcgcggtcggtaaaattcagcccgatcatgcaaacgtcataacgctcaggcgtctgacgcgaacgacgttgatgctcgctcatcggcacgcccgtcacacggtagacctccaaagcgcgcagaatgcgcccaaggttgtttgggtgcagcgcggccgcaagctcgggatcgaccgcgcgcagcatctcaagcatatgctcgtttccatgcgcttcggcctgcgcgtacagttcggcgcggaccgattcatcgctgcggatatttgaaaagtcaatattgtcaatgaccgcgtcgatataaagacctgtgccgcccgccagaatcggcacgcgcccgcgcgcggcgatatcggcaatcacggcgtgtgcgcgccgcgcatactgcgcaacggaaaacgccgcgccatccggctcgatcagatcgatcagatggtgcggcaccccctttttctccgcttcgtcgggctttgccgtggcaatatccatccgtttataaacctgcatcgaatcggccgagacaacctccccgccaaaataaagcgccagctcgaccgcgagcgccgtctttcctgaggctgtggggccaaccaccgcgatcagcggctgtttttttagcgtttcattcattgttcatccaagcctgccgaattttttctcgatttcatgccgcgacatacggatagacaccggcctcccatgcgggcagtgatccgcgtcgccgtcggcacgcagcagctccacaagctgacgcagcgtcggagcggccgtccggtcgtgcgccttgatcgccgagcggcacgccattgtatggtacagctcctcaagcacatgcggcgtcaggcgctcgtttgcgagcagcaatttctgcgcgcactcagtaacaatcgctgcgaggtcggcgtcagccagcacgggggccgcctcgcgcacgacgacaaacccatcgccaaagtcctcgatccccacgccagcacgcgccaaaagcggcgcatgctccagcacggcggcatgctcctcaggggacagatgcaccgaaacaggcgtcagaagaagctgccggtcctccccaggcccagccgcgaccaaacggttgtaaagcagccgctcatgcgccgcgtgcttatcaattaaaatcatttccggaccattttccagcacaatatacgtcccaaacaattcgccgatcagcacggcgttttcatagggatcgtccgccgcgcaggccggctgtatcataacggaaggcgccgcttcttccccggcgggcgcggcaggaaaatcccgcggcggcgcctgctccgccaataccggcagtgtccgggcagcaagcgccacaggacgcgcggccgcataggaatcggcgtatggattcgcgcttgaaacagactgtgcgtcatcatcatccggctcgtcaaacacaatatcaattgcacgatgagaccggatgcgcgtctgcggtgaatgagcctgcggcgccggcgcgatctccggcgcatttaaaacgcaccgctcctctttcccctgcgcggccggctccaacgcgcgcatctgttcccggtactgctctgcgctcacgcgcgcgggctgttcatccggcacgccggtctgtatccggtactgcgcggcgctcatacgctgctgctttggcgcctcgggggcggtatgcgccgcaaacggattgtaacgcagctcgtccgccttgatctccggtgcgagccggtgcgcgcccagcgccgtcttacagccgtaatacaccaggtcgaacacgctcttttcattcgcaaagcgcacctcggttttcgccgggtgcacgttgacatcgacggtctgcggcggaatcgtcaaattgagcacgcacgacgggaaacgcccgaccatcagcatgttgcggtaagcttcctcaaacgctgccatgcacgttttggagcgcacaaaacgcgcgttgataaaaaaattctggagcgtgcgcgagccgcgcgcaaacgacggcctgctgatcagtccctcaagcgccaggccctccagctcatacgacaccgggatcgtctgttccgcgaattcgcgtccaagcacacaacgcgccgcggcggccagttggccgccgcccggcgtttgaaggcgcaccgcgccgtcgcggataaacttaaacgaaatttggggattggccagcgcctccttttcgacgacggccgccacgctgtttccttccgaaaggtcctttttgagaaatttcatacgcgcgggcgtattatagaacacatcgcgcacactgatcgtcgtgccgacgggacaacccgcgtcggcaagctctccaggttcgccgcccgaaattgtgtaccgcgtcccagcgatctcgtcagccgtgcgtgtgagcatctcaacccggcacatcgctgcgatcgacgcgagcgcctcgccgcgaaagcccatcgtggtgatatgccccaaatcctcctgcacgcgcaccttactcgtcgcatggcgcaaaaacgcgtttttaacatcttcacgcagaatgccgctgccgttatccgtcacacggatatagcgcacgccgccgccctggatttccactgtgatctttgtcgcgccggcgtcgacggcattttcgactagctctttaacgatcgacgcggggcgctccaccacctcgccggccgcgatcagctccgcaacctgccggtcaagaacattgatttttgccacgcgtcatctcacctgccctttcaatcctttaaaagcgttttcaattcataaagcttattcatcgcttcaatcggcgtcagcgtattaacgtcgattgcacgcagcgccgcttcaatttccgaggcggcggccgatccaaacgtcatttgcggcgctgtttcctcctgcttttgccgcgccgcacgggcgggcgcaacctcgcgcccctgctcaagctgttcgagcacctggcgcgcgcggcggataatccagtccggcacgcccgccagcttcgatacctcaatgccgtagctgtcatccgcgccgcccggcacaatccgccgcagaaaaatcagctcgtcgccgcgctttttgcacgcgatattgtaatttttcacattggaaagcgtgtcctccagcgcggtcaattcatgataatgcgttgcgaacagcgtctttgcgccgacgcgctttttatccgctatgtattccaacacggcgcgcgcaatactcatgccgtcaaaggtcgacgtgccgcgtccgatttcgtcaaggatcaacaggcttttggacgtggcctgcttcataatctgcgccacctcggtcatctcgaccataaaggtcgactgcccggaggccaggtcgtccgaagcgcccacgcgcgtgtatatcccgtcgacaacaccgatacaggccgacgccgccggaacaaagcttccgatctgcgccataagcacaatcaaagccgtctggcgcatatacgtcgattttccggccatattcggaccggtgataattgcaatctgattttcaccgcaatcaagcgtcgtatcgttcgacacaaacggcgcgccgtccatcagctgctcgacgacgggatggcggccgtcgcgaatcagaatcccatccgacaggcccacatccggccggcagtagccgttcgcactcgcgacagcagccagagagcagtaaacatcgaggcgcgccacggccgacgcggtcgcctgcacgcggtgaagctgcgctgaaacggcggcgcgcaccgcctcgaacgtctcgttttcaagcgtcgcgatcctctcgcccgctgaaaggattttttcctcaagctgctttagttcctgtgtgatataccgctcgcagttggcgagcgtctgcttgcgaatataagtatcgggcaccaacccaagatttgatttggaaacctctatgtaataaccgaatacacggttgtatccgattttcatattcttgatgccggttttttccttctcctgcgtctcgatgccgacaagcagctttttcgaatcgtgaatgagcgcgcgcagctcgtcgagcgcggggctgtatccctcccggattacgccgccgtccttaaccgccgcaggcggttcgtcaacgatggcgcgcgccagcaggtccgacacatcctccaacgggtcgagcgcgtcgcgcgcctcgcagagatacgcgctcgcacagccctccatgcgcgccttgagcgccggcattttgcggcatgcgccttccagggctttgtattcgcgcggcgacgcgctgccatagatgatacgcgtcatcagccgttccagatcaaatacgccggacagcgaatcgatcaggtcgcagcgcagcatcgtatcggaaaaaagctcctccacagcgttgagccgtttgttgatgactgccggatttacaagcggcttgtcaagccaggcgcgcatcagacgctttcccatcgccgttttcgtccggtcaagcacccacagcagcgtgccgcgcttttcgcctgtacgcatcgtctgcgtcagctccagattgcgccgcgccgtcaaatcaagcgccatcgactgttcggggtttacataagcgatgtcggtgatgcgttcaagccccttctgctgcgtctcataaagatacgcgagcagcgcgccaagcgcgcgcgacgcgagcggccggccgtcaagcccgagcgcgccggacggctttgaaaagtgccgggcgatcagatcctcggcggcctgcggatcgaaccggtcgttatcgcacaggtcggcgacacagtgcagcttcttttgaataaacgcggtcacttccgtctgatcaagaatcccctcgttaaaaatgatttcgctcggacaataacgcccaagctcattgacaacctctccctgcgcgtccgccgcaaactgcgaaacaaagagctggccggtcgaactgtcggcacacgcaagcccccatccctgatcgaacaggatgcaggcgatatagttgttcgcatcctctgagagcatattgctctctatgagcgtccccggcgtaacaacacggatcacgctgcgcttaacaacgcccttggcatcggccgggttctccatctgctcgcagattgcgaccttataaccctttttgatcaggcgcgcgatatatgtttcacacgcatgaaacggcacgccgcacatcggcgcgcgctcctcctgcccgcagtcgcgtcctgtcagcgtcaattccagttcccgcgacgctaaaacagcgtcgtcataaaacatctcgtaaaaatcgccaaggcggaaaaacaaaatatggtccttatgcttttcctttatggcaaagtactgctgcatcatcggggaaagcttctgcatgtcaatcttcatcctgggcgacctccagagacattttgaccgccggcaaaacgctgccggcagtctcataatctttaaaacggatcaactgcagccggaacacgacgaacagcttcccgagcagccggacttcttctcgatcagatccgggtcctcgccgttgatgcttccgcgcagaatctgcataacgaaatcgaccgtatcgtcaaattccgtcttggctttattgtaagcggccatattttcattgtccatgatctgcccgtaaaccgcgcggacttcctcattgagcgcagtcacgcgcgcctgatccttgtccgtcttgttcagctccgtgtttaaattgatacgcgcaaggttaaacttgccgatcaacgcctggagcgtctcgtccgcgtcattctgctgctgcgcgaccatcaggcgcagatacccttcgtcctgttgaagcgcctttccaagctgccttgccattgcgattacatccatttttcgttcctcctgtattgatgcgcccgttcataagttccgaacgctttttatccctctttgagccgcccgaacagcgcccagttctgcgcgcgctcgatcgccacatcgacaaagctgccgatcatcgcgcgcggagccgtgaattcgacgatgtcgtttccctgcgtgcggcctgtcagccagccgtcgccgctgcgcccttcaccctccgccagtacgcgcagggtcgtaccgacggcgtcagcctgcatcccgctgcggatgtccgattcagcgtcaagcagctctcgcagccacagggacttgtccgcagcgggcgttgggtcctccatcccggcggccttcgtaccgggccgcggagagtaaataaacgtatagagcgcgttaaagcgcacgcgcttaataagctccagcgtctgttcaaaatcggcgcgtgtttcaccgggaaagccgacgatgatatcgcttgaaaacgtgacgcccggaatacgcgcgcgcgcatagtcgatcagctccagataatgcgcgaccgtataatgccggttcatcgccgctaatatacggtcgctgccgctctgcaccggcaggtggatatggcggcagaccttattacacgccgcgattgtgtcgatcagctcatgcgtacagtccttcggatggctcgtcatgaaccgaatccaaaaatcgtcctcgatctcattgacgcgccgcagcagcgcggcgaaattaatcggctccgaaagccccttgccatacgaattgacgttctgcccaagcagcagcagttcgcggtatccctgtccgacgagcgcccgcgcctcattgagcacatccccggggttccggctgcgctcacggccgcgcacatacggcacgatgcagtatgtgcagaagttatcgcagccatacatcaccggcagatttgctttaattgacccggagcggcgcagcggaacgccctcgataatctccccgcgcgcattttcggtggaaaactggcggttttctcccaaaaggcgccggtaaagcagctccggcagcgtatgcagggcgtgcgtaccgaacaccagatcgacatacggatagctttttttgattttatccgctacggcctgctgctgcatcatacagccgcacaacccgatcaacatacctgcgcgccgcttcttagccgacttgagagcgccgacgttgccaaatacgcggtcctctgcattttcgcgcacagcgcaagtattgtagatgaccagatccgcttgttccggcgcgtcggtgaagccgtatcccatctgcgcaagcataccggctatcttctctccatcgctttggttttgttgacatccaaacgaatggacgtaggccatcggcggatggtcgtaacgcgcggccagcaattcgcggacctgccgactatactccatctgccgcaagagtgccggcgacaaattctgctgtggcaaaacgcgttctctcccctttacatgttataatcagtttatcttaccatttttcccggcaaaaagcaaggagctccgacagcaccttcattcctctgaaatgacaatatatgaaacgaaccgccgcagcgcgttggcagatgaccgggatgggtatcagtcaaccttcaacataaagagagccggcatattgacatgttgaaacggatccgggtttgtgataaaataaatgcaaaagcatttattttattccttatggccagggcgatacgcgggcacagcccgctgccgccctgatagccaattttatcatgccgcgctgcggacatgataaaataaccacaataaatcgcaagaggtggtttttcaatatgtctgttatgcgtgtgcgcgtatctttcagtatgcttgtatccagcatcctggggtttgtgatagcggttccgttctcccttctcgctggtttcctagccagcccgatactttacgaataccagatgggtcgggtggatatcggaccaggcagcgtcggtaccgaggccctgccggatacccctatcgccgcttccatcgcagatatggaacagatggggcgttttacaatcgaagtcaggcgcgattttatgagcgccagctcccaccgagcgctgaaatggaacgatcaaacatattataccatcgatctgccaagcggcgagcggattgccgccctgattaatttcaaagccttgacggatatggcgtatactgattcgcgtccccttgctcctgacacgctgcttcccatcgggcagtgggtggaatggaaacacccgggttcggacgaaaaatcctacaaaaactattatgacggcctctacactgatttttcccattatgttgacatgagcggcgatcctggcaatctgccaaccaaatccggtgcatttggccaagtgatgatcgttgtatttttaattctgtacatattcttttggcgtctgagttatcgcatcggcgtaaaaaaaggacttttgaagccggatcctcccctttttaaacgcagataggctcgatccgctccgccaaccgtttgatagaaggaaaaagccccgctgtgttaagtcacagcggggcttttttcatgcgagcgacgcgccaaactctgttccgagcgccttcgctttttcaagatctgcgccggacgggacaaagcagaccttaagtccgtcgccgaacaccttcattttgagtccggtcagacgggtctgaagattcggcaccgcttcgccgctccatccataggaaccaaataccaaaaccggttttttcttattgttgatcgcatcgacatgcgacagcagcatccatgccggcgggactgcctcgccgttgatcgttggactgccgagcgcgaacgcatccgagctgttcagacgctcggccatctcgcccatatcatagtcaatgatatcaaatgtctcaacatcagcttccggccgcgccgcaagaataccgtcgcggatcgcagcggcaattttgcgggtgttgccgtaagcggaggtataaaaaaccggcacggtcagccgcgcatttttctgcggctggctccactcgttgtatttttcaagcacataggcaaggcgacagcccttagtaatgatcggcccgtggctgttgcaaacacgctcgatcggtaaattcttgattttctcaaggccagcgagcacatagggcttaaacggaccaaagatcgcgtcgtaataccccttgaacgcaatttcatattttgcgggataggccatgttataatcgaaggtatatggctcgcagtagtgcgcgccaaggaaatcgcagctaaacagtgtcttttcctcctcgacccatgtgaacatggagtctggccaatgcaaaaacggcgcgttgataaagcgcagcgttttcccgccgatatcgatcacatcgccgtccagggcaacctgaaccttcaaatccgtgcggttcgtaatgtttttcagatagattgaaccggcctttgaaacgacgactgttgcattcgttgcataatcgagaagctgcgccagagcgccggaatgatccggctcattgtgattgaggacaatataatcgatattcttcggatcgatgacctcgcggatattcgcaaggtactgctcaaaatacgtcttgtggcacgcctcgatcagaacgttcttttcgcctttgagcacatatgaattataagtggtgccataatcggtcgacatgacaatgtcgaacacgcgcatattcggattgagaatccccaccgaataaatgctgtctgtaacttttactgccgccatttcaaacgacctcctgttaaaatgagttgtgaccatccggatcggctccgggtggtcacaaattgctggtccttaaccttggacttcgaacatgtccttgcctacgccgcactccgggcagacaaaatcatcgggaacatcttcccacttcgtgccgggagcaattccttcatccggaaggcccttctcctcatcgtacacgaatccgcaaatagtgcaaacatattttttcataatgctgtctccctttctgataatctttctttatcaatactataccatgacagtatatctttgtaaaggttattattgccgaattttgataaatttataacatttttttaagatattttcccgtgtaagacgcctctacccgacaaatttcttccggcgtgcccgcagccaccagcgtgccgccgttgtctccgccctccggaccgagatcgatgatataatccgccgttttaatgacctctaaattatgctcaattgtaataaccgtattccccgcatccacaaacgcctgcaaaacatcgatcagtttgtgaacgtcagccgtgtgcaggccggttgtcggctcgtcaaggatatagacggtgcgtcctgtcggccgctttgaaagctccgtggccagcttgacccgctgcgcctcgccgccggaaagcgtcgttgccggctgcccgaccttgacatatccaagccctacgtcgtaaagcgtctggagcttgcgcgcgattttcggcacgttcttaaaaaactccagcgcttcctcaaccgtcatttccagaacgtcgtggatcgatttgcccttgtatttgacctcaagcgtctcgcggttgtatcgccgacccttgcagacctcgcaggggacgaaaatatcgggcagaaagtgcatttcaatacgcacaatgccgtctccctcgcacgcctcgcagcggccgcccttgacattaaaggaaaaccgccccgacttgtagccgcgcattttcgcatcgttggtctgtgcaaagatctcgcggatatcggtgaatacgcccgtataggtcgccgggttggagcgcggcgtgcgcccaattggggattggttgatatcgatgaccttatcaacctggtcgatcccttctatatcggtatgcttgccgggcttgacgcgcgggttcgtcaggtcgcgcgtcaggcgtttaaagagcacctcgttgatcagcgagctttttccggaaccggaaacgcccgtcacagccgtaaatacgccgagcggaatttcaacgtcgatctctttgaggttgttttccgccgctccgacaatctttaaaaacttgccgttgcccgtccggcgtgttttaggcacctcaatgcgctgctttcccgataggtactgtccggttacggagcgttcgcagcccttgatctcgtcaatcgttccggcgcagacaatctcgccgccgtgtacacccgcgcccggcccgacatcgacgatataatcggcggcatacatcgtatcttcgtcatgctcgacgacgatcagcgtattgcccaaatcgcgcaggcgcttgagcgttgcgatcagcttatcattgtcgcgctggtgcaggccgatcgacggctcgtccaaaatatataaaacgcccatcagcgacgagccgatctgcgttgccagacggatgcgctggctctccccgcccgaaagcgtcccggctgcacgcgccagcgtcagatattccaaaccaacgctgcgcaaaaagccgagccgctcacggatttccttgataatcagctctgaaatcatccgctcgcgcggcgtcagctcaagcccatcaagaaattcaagcgcgccggccaccgattttttgcaaaattcactgatgttcagcctgcccacggtcacggccagcaccgtcttgttcagcctgtcgccatggcagacagggcattcgacgctgctcatccatgttgaaagctcctcgcgcatccagcttgaatttgtctcccgaaagcggcgctccaaattattgacgatcccttcaaaatccgtgtagtaagttccctttacacttccgccgtcacgatgcatcttgattttttcaccgttcgtaccgtaaagcaaaatctggacagcctgtttaggcagcttggaaaccggctcgtcaagcgaaaaaccgtagtgctcggccaagccctcgtaatacatctgagcgatgccgccttcggcataataccagccggacgcgcggatcgcgccttcccggatggaaagacgcttattggggatcaccagatccggatcgatcttgagaaacgtccccaggccggtgcatttatcacacgcgccgtagggggcgttgaaggagaacatacgcgggttcagctcctcgatactgatatcatggtcgggacatgcgtaatttgaagaaaaggtcagctcctccccgtccacatcgacaacggcgagcccgcctgtcagactgatcgccgtttccagcgaatcggccaggcgtgaccgcacctcctccttgatgacaaggcggtcgacaacgatttcaatcgtgtgttttttattcttttcgagcttgatctcctcagacagatcatacaggttaccatctacacgcgcgcgcacatatcccgaacggcgcgccgcgtcaaactcccggacatgctctcccttgcgcccgcgaaccgtcggcgcaagaatctgcacgcgtgtgccggctggcagctccatcacgcggtctaccatctgatcgaccgtctgctgctcaatcggccggccgcagaccggacaatgcgggataccgatacgcgcatagagcaagcgcagatagtcataaatctccgtaacagtcccaaccgttgagcgcggattcttcgatgttgttttctgatcaattgaaatggccggcgacaggccctcgatcgaatcaacgtcgggcttttccatctggcccaaaaactgacgcgcatagctcgacaggctttcgacataccgccgctggccgtccgcataaatcgtatcgaacgcgagcgagctttttcccgatcccgaaagtcccgtaaagacaatcagcttgtcgcgcgggatctccagatcgatgtttttcagattgtgctcccgcgcgcccttgattacaattttatccaatgccataaatgtttctgttcgtctcctttacttcggcagcctgcccggacgttcatcctccgccttcagcttttgaattttatccctcagatatgccgcatgctcaaattccaaaatcttcgcggcatttttcatctcgagcgtcagcttcgcaatcagcgcctcgcgctccttgtgcgacagcttctttccacgctttttcctggtatcgcggtcgtcgcgcgcggaaatttcaaggatatcgcgcacatcctttttaatcgtctgcggtacaatcccatgctcctggttgtaagcaagctggatttcacggcggcggtacgtttcagaaatcgcgcgctccattgactctgtcacgctgtccgcgtacatgataacctttccctgcgcattgcgtgccgcgcggccgatcgtctgcaccaacgacgtttcgctgcgcagaaatccctccttgtccgcgtccaaaatggcgacaagcgatacctccggaatatcaagcccctcgcgcagcaggttgatgccgacaagcgcgtcgaactcaccgaggcgcagatcgcgtatgatctccatacgttcgattgtatcaatatcgtggtgcatataccggatgcgcacgcccatgttttccatataagtggtcaaatcctcagccatcttctttgtcagcgtcgtgattagcacacgttcaccggcggccgcgcgctggttgatctccgagagcaggtcgtcgatctgcccttccacaggccgcacctcgatctcgggatcacaaagccccgtcgggcggatgacctgttcgacaatctgcgtgctcttttcgcgctcaaatgcgcccggcgtcgcgctgacaaatacaatctggttcagttttgcataaaattcatcgaaattgagcgggcgattgtcgagcgccgacggcagccggaacccataatcgatcaggctgatcttgcgggagcggtcgccgccgtacatcccgcgcacctgcgggagtgtgacgtgcgattcatcgacgaacagcacgaaatcctcgggaaaatagtcaagcagcgtatacggcgtactgccgggggcgcgtcctgaaataacgcgggaatagttctcgatgcctttgcagaaaccaatctcctgcatcatttcaatatcatagtttgtccgctcggcaatgcgctgcgcctcaaccagcttgccgttttccttgaaatacgccacgcgttcgtcagcttcgcgccggatctcctcgatggcgacgcgcattttctccggcggaacgatataatgcgaggccggatagatcgcagcgtgcgtcacgacgttctttacttcgccggtcacggtgttgatctcggtgatgcggtcaatttcatctccgaaaaattcgacgcgcaccgccgtgtcgcccgaataaaccggaaagatttcaacaacgtcgccgcgcacccggaacttgttgcgcacaaagttgatgtcgtttcgctcatactgaagctccaccagcttcttgatcaattcgtcgcggtccttctgcatccctgtccgcagcgacacgaccatatttttataatcgatcgggtcgccgagcgtatagatacatgacacgctcgctacaatgatcacgtcgcgccgctccccaagcgcggcggtcgccgaatggcgcagcttttcaatctcgtcgttaattgcggaatccttttcaatatatgtgtccgtatgcgcgatgtacgcctccggctggtagtagtcatagtagctgacaaagtattccaccgcattttcggggaaaaattcgcggaattccgagcataattgagcagccaaagtcttgttgtgggcgagtatcaaagtgggcctgtttaccctctcaatgatgttggccattgtgaaggttttgcctgaaccggtgacgcctaaaagcgtctgttcatgcgctcccgcgaggattccgcgggttaacgcctcgatcgcttccggctggtctccggtcggtttaaacggcgaaaccagtttaaatttatccactagaaatccccccaatgcagcctggaataatttgcaaatctatttcttaattttgttcaaaaacgaaaatggtcactaaaatattttcccggattaaattttgctttctgcacagattaatattatactacacaagacctctccaagcaataccgctgtattgcaatatctgagcatatatcccgcaaaccaaaaaggagcattcctgcttcctcttattcgattttctcggcatggcgccttcttaaacaaaaatccgcctatttcagccataacaaccgcaataggcggataacttttttaagaaccagcgggcgcttgatggaggcgccgtccagtgacacttcgcggagcggccagcttcccctttgggtgatgatctcccgccggcccccatcgatcagataggtatcctccggtttaacgcccgcgatcgtgcgggtttcatgagaatacctgatggggctgcaccgtctcaacgcacgcgtctgcgcaacagttgatccaagacatctgcctagcgcccgcaataaccgcggcgctcaattcgggcgaaccgtttgcccaccacctcccagtcgtgggcgctatggggatgtttaaaaacagcagacatctggtatgataaaaagataggagacacgaaaagccgtgtctcctatcagctttttaaattatttgttcggaagctgggaaatccctgaatggctgcgctgggcctcgaacgtccgtgcctttgccactgcctgttggctcatacaccagaaataatcggccggagttcccatagaggcaaaggtcgcgccctgatcaatccaaaactttatcaaatcataattgacgccgatggatatgccaaacggaatgtggtgggccttgcaggtatcaatgatcttctgcatcagccctaccacttcagggtcggtaagctgtcccatcttaccgatggaagcggataagtccatgggaccgcagatgatgccgtccaccccgggaacctccaagatctcatccaaacggttaacgccgtctacgtgttcacactggagcagcttcaacacgctgcggtcggcctgagccagatatttctccaagggcatattgccgtattggatggcgcgcagaggtccaaacccccttactccccgaagcggataagtacatacagaaacacagtgttccgcctcctggggcgtatttaccatagggaaaatgataccatccgtccctacctccagcacaggcttgacattggaaatgtcgtggttctgtacccggacaaaagcggcgcagccgccggcgttggtagccacgatagcgttttgcaccattggcatggtcatgcccgcatgctcgttgtcaatccatacataatcataacctaaaaaaccacacatttcataataccaaggttcagtagtggaacagtgggtgccgaaacacaactgcccggattccattttttcacgaatgtgatcaagtttcataatataaccgtttcctttttcataattcatgtgacggtgcggtatcccgcaccatggcttactattggggctcctgatcttgtttcagagcctgagccgcttcagcaatggccttagcgtcatcatcctgcttcatagcctcagccttttctgcatccaaccggcgagtgaccgcgccgtgggtaacaatatccatgacgctgaaaatcagatcacgcatggtaaagagcgccataaagaaggcggaaacagggatacaggagtaaaagtagcttttcttcataaagtgcagggtgtacatcgcggcgtccgatttcatgcaaagacggacgccaaaatagaagattacggcataggtcaccaacatcagggcggtggagatcaccgccagaacccgccctgtagcggtaccgtgaaagtggtcagtgagaatatccaccacaaaatggcctctggtgcggaccaactccgccgaacccaggaaaatcatccaaaccagaaaaaattggatcgtttcatcaatccacttggggttataggtgataaatggtaagcgcgtagcaatgttgaggataaacagggcaaacacaatccccaggcagacagaggcaatgctccgcatcaggacgcccacaatgttctcaaatttattccagtacttcatgggggaatcctccttacacagaacccaaaccgggcaggaacagggataacgggctgataaaagcggccagcagggccaccgtaatcataataagtacaaaggggactgcttctttggcaattcgcataaccttttccccagtaatgctggacaacacatataagttcaggcccacaggaggagtaatcacgcctacagacagagatatacacatcaccacggccagttgaatgatactgtagttataagcttgggccagagggacgaaaatggggacagtgatcattagaatagcggttccctccataaaacagcccataataaccagcatcaaaataataataagcaggaccggaactatgctgccaaaaacgctgacaatcgcatttaccgcttgctggggaatgcgggtacgcagcaggacgtactggaaaaaagaagcggtggcaatgacgaacataatttgtgcggaggatttggcggtaatccaaaagatatgggggaaatccttcagcttaatcttgcgatacttgaatatccccaatagggcagcgtacagagctgctaccgcggcagcttctgtagcggtaaacaagccgccgaacatgccgcccagcacgatcactggagtaaaaagcgcccaaatggccttgccgaagtaacgcagacgttctttcatcgggatgggaggtactttaccaaaatttcgctttttgcaggcgaaactggcataggtgataaacatgatgccgataagcactccggggatggctccgcccataaacaaatcgttgactgaaacccccaccttggggtccgaaatcatactggcaaacaggatcatggtgatgctgggaggaatgatgggtcccagaccgcccgatgcagcgatagtcgcgcaggaaaaggactgttcgtatcctgtcttgcgcatctcagaaatagcgatcatgccgataccggcagccaccgcggcggccgagccagacatcgcggacatgaccatgcaggagacaattgcagcgttagccagaccgccccagcgatggcccaggcaggcacgggcaaagccaaacaggtcttgggaaataccgccggcattcataaaattgcccatgagcaggaaaaatggaatggacatcaaagttatgccgctgacctggttaaacatcccctgcggcaaagacatcatgttggacatcgtggcctctcccagagaaaaataagctcctacggaaaccaaggccatactgcacgcggtggatacgccaatgaacagcaccgccagtaccgcaataaacataacaaacataatcatgggggtaatctcactctcctttcagccgtaaagatgccgcggtcggcggcaaatagcgctgggggccttctaactgtgattcaggcgctctctgaagcggcctttgcggcagccatcaggttatccagctcatcctgaccgcacagggaggctatttcttcataggccggtgccattttatctataaaggactgcttatccggtgtggttacgttcattcccttatctttcagtgcctctatgtccgcatcctcaccatcagcgatgaggttccgggtgacctgctgcgcctcaagagcggcattctgaatgatctgctgaagctcgggactcatagactcccacagcgacttgtttatcagcagggtttgcacatcaaagaaatgaccggtgagagccagttggttttgacactcaaaataggagtctgctaggatggtggccacagggttctcctcagccgctacgaccccctgctttaaggactggtacagttcggaataggcgatggtctgtgtgttgcatccaagcgcgtcaaaggtggccagaagcccggcggatccggggacccggatcttgacgccgtttaaatcatcagcggagttgaccacgatgtcgttggtcgtgacatggcggaaaccgtagtcaaacatagccagggcatgcatattcatctgcgttcccacatcctcattaatccagtccagcacataatcgtccatgaccttatgtgcatggtcgtagctgtcaaagaggaatggagcggccaaggcattgagttttggcatataggtggccatattgctttgggaggcgatgaccatatccacatcgccatcggtataacagctctcgatgagagcgggctggtcccccagttcgctggcgggatagatggtgactgtgaccttcccgccggtctgttccgaaacaatatcggcaaacgtctgagcagcggtattatgcgcgtgactggtggcggcggagtgagccagcgagatgttcaattcaggaaatccatcctcctgcacatcactgctggaaatatcgcctccggagccgcagccggccatcagagacaggcaaagagccgtgcccatacccaacgctaaaattcgattccacttcatatttgagttcctccttttcatctgtaacgacaggatatgtgggtggtgcgattcttcgcatgggaatcatttcacaccatagagtgaagtgagaatattttggacaatatcctcataattcaacaaaattccaccgcgatgacatcatgaatatatcatattccccaaaaaccgtctatctaatttcattaatttcagaaatttcatgaaaataaccttgcttttttgaaagggaaatcttatgatagaaaagtaaaatacaggtggggagcagaattgccatgatcattctacaaaagaccattgctgaacgggcaggggtgtcctacgctaccgtttcccgtgcctttaccaatagcgccaaggtaaagccgcaaaccatgcagaagatccgcaacgctatgcaggagcttgggattaccgacggagatgatatgttgttgggaaagggctttgtgtccaaagcggtgcttgtcattgtcagcgacatttcgaattacttttattccaaggtggttaaaggcatctgtgaggggctggaccctttggggtatacggttgtactgtgccactgtggtttggatgccaaccgggagctggcagccatgcgccgcgccatggaaaacggctattccggcatcattatgattactgtgaccgcaacagaggaaatcatacaattgctgcaaagctcatctattcccattgtactggtcaaccgctatatctccgccctggatctggatacggtgcgtatcgacaactatcggggaggctatatggcagcgcagtatctctgggagcgggggcaccgccatatagctatgctcactggagtaaagggttccgggaccgcatctgaccgctgccggggtttctcggaggggctgcaaaactatggcctgtccttttccagcttggatatggtatacggggacaacacccgggagagcggacgaaaatttgccgactggctgttggctcaagaaaaaccctgcaccgctgtatttgtgggcaacgactatatggccgcaggaatggtgcgccgtctgcgggacgcgggacggcgagtgcccgaggattacagcattttgtgctttgatgactctgatctggtagacgaggaagggctggacctgaccactatcagttgtgacccggtggccatgggactctccgccgccgatgtctttttacagcggcaggataacctgctcggccgccgtttccgcatcgtctactcccccagtctgaaggaacgcagcagtgtacgcaacatcgcagaaaaataaaaaacggttgtaaaacaactgttttttgcgcatctgcccgttccgcggacagacgtatttaatcaaacggccccgcgccgcctgcggcgcggaaagccaatttaccttagtttattcagcaatctatgggaaaaacatctaaaggaggcctctccctatgaatgaagcaaaagatattgcccaaggccgctgctgcctgggtatcgagttaggttctacccgcatcaaagccgtactcattggctctgatcactcccccctagcctcgggcgagcacagttgggagaatcggttggaggatggtatatggtcctaccgcatggaagatgtatggacaggactccaaaaggcttacgccaagctgcgcggcaatgtattcacccaatacggcgtggaacttacttccatagccgctatgggcttctccgctatgatgcacggctacatggccttggataaaaacggagaactgctagtccccttccgcacctggcgcaacaccatcaccggacaggccgccaggattttaacggagcgtttccagttcaacattcctcaacgatggtctatcgcccacctctatcaagccatcctcaatgatgaggaacatgtcaaggatatccgctgtcttaccaccctggcgggatacgtccactacaggctcaccggctgtcaggcaatcggagtcggggaggccagcggcatgttccctatcgatagccgcaccggggactatgatcagacaatggcagacgccttcgacgccctggtggctgagaagcactatccatggaaaatacgggagattctgccgcaggttctccacgccggccagcccgccggaaccctcaccccagagggagctaaacttttggaccctgccggccttttgtcccctggcgttcctctggctccccctgaaggagacgcgggtactggcatggttgctaccaacactgtcgttccctgcaccggcaatgtgtccgcaggtaccagtgtgtttgctatgatcgtgctggagaagcccttgtccaaggtctattctgagattgatatggtcaccaccccatctggacagccagtagccatggttcattgcaacaactgtaccaatgagatcaatgcctgggcacaggtatttaagggattcctggaggctttggggcaggtccctgacatggatactgttttctccgctatgtttcactccgctctggctggtagggaggatgccggcgggctgactctttataattacctgtccggtgaaccaatcagcggattaatggagggccgccctctattggtacgcactccttggtcccaatttgactttcccaacttcatgagagcccacctctactccgccctggctacgctgaagatcgggatggatcttctgtctgaggagcatgtagctgtccatcggctgatgggccacggcggcttctttaagactccggaagtcggccagcgtatcctggctgccgccaccgcaacctgcgtttctgtcatggaaactgccggcgaaggcggtccctggggtatggccctgctggcagcctatctggtagagaaaaaatccggacaatcactggaggattaccttgacaaccagatttttgccggccagaccgtagttaccttggaaccccgtcagcaggatgtggagggtttcaaccagttcatgaggcagtatcgctgcggtctggcagtggaacgccaagcggtggagagtttaaaagcataaacacaccgattacacgctttactataacctataaaaaattggacatccgtgcagttaccggcacggatgtccaattttttataggttctttctgaaccccctgacacaagccgaaggttctcaagtgcaataaaaagcacacagcttaaaatcattgctgtaagaatccccacagaggcggctgtcagccgcccacaagcgcatagtatgcgcccctacaggatattttcttatcgcaataccctcttaacggggaattttttatctttatttgcactgcatcaaaacaaaaattttaaaattccatttcaaagcgtcacatctgcgccggacggattttgccccgacaggctgcggccgtgcgtcacacgcttgtaaacagccagcaacagcttttcggcccatcgcctaatccgaaactgtgcgtgatccaattcgctgcccaaaggttccaccagaaccgtatgcatcccagcacgatttccgcccataatgtcggtaaacatctggtctccaaccaccatacatcgttccggttcgacaccgagccgacgggccagctccagaaaagcgccggatgcaggcttttgcgcatgggcggcatagggcgcgtcgaacagctttgcaaacgccttcacacgcggcgggtcgttattggaaatcatcgcagtctgacagccgtaccggtttaaaaaatccaaccattcccgcgcctgaggctcaggatccggcgcgtctaccaaggccagcgtattgtcgatatctgtgatgacggcctgaatattcaaccggtccaggaggctgccgtcaatacaggttacatccttcgcaaaataatccgggaacagattgaacaatgcttccacaactccctgtttctcattttcccgcacaggacggttccgcgtccacaattgcatctgcgcggcaatgcttgcagcgcacaaactgttccagattgacgccgcacctctcccgcatctgttccaactgctccgcgtccggcggagtaacctttgccattgtatcgcgcgcgatcaccggcagaatattctgaagcgtggcgcctatcgcacgcatttcccgggaaatctgcaaaatgtcatcgtcgttaatacccggaacatagaccgaattgattttaacaaccatgccagccttgacagcctctttgacgcctgtcctctgacgctccaaaaggcgccgtacagcgttctctccccgctcgcccgatacatgctcataaatatgtacagccacattcggcgtatgggcattgactgttacagtcagcgtctcaacaccaagctgcgccagccggcttgcctgctccggaaggaacagaccatttgtacttagacagagatgtatttgcgggtattctgcttttataaggcgcagcgtctcaaaggtttcaggatttgccaacggctcccccggacctgcaattccgacaatgcggatatcgatcccgctctcacgaaccctgcgaaggtgctccaaagcctgctgcggcgtcagaatctcgttggctagtccaggagcgcatccgtgtatacacggattgactgtaggacggcaaaacgcacattttatattgcagtatggtgcgacagccaaatgcatacgcgccacacgcgctccatgattggaaaagcagggatgctcaaatgagagcgtggaatgaattgttgattgactcatattttacttccgttttctggcgtacgggtcaagcgcatcattcagcccgtcgcccagaatattaaatgcgactacaataataatcagcatcaggcccggatacagaatgtaccacggacaaatggtcatataaccgcgcgcatcggcgatcatatttcccagtgaaggagttggcggacgaataccgaatccaaaaaagctcagtccggattcgtacataatcgcgcctggaattcccattgaaaaggatacgataatcagagacaggcacccaggcaaaagctgacgcgtgatgatccagaaatgcgacgcgccaagcgcacgcgacgccttaacatactccttctccttaagcgccaatgcctgcccccgcaaaagccgtgtgacatccggccagccgacgacgacgagcgcaagacaaacagtaaacaggctcggccccatgacgagtgtgatcaccatcgccaacagcatcactggaaaagcgagaaaaatatcggtcaggcgcataatgaccatgtcgacccatccgccaaaataggctgccgcaacgccgagtacaattccaacaatcatggtaagcccgcgtgcgacaacgcctaccaacagagaaacacggattccatacagcacgcgggtaaagatatcgcggccaagctggtctgtacccattatgttcgcaagatcaggcgcaaatggcggaaacagatttttcccatcgaccaccctgcgcgactcgatggcctccggatcgaggccgagaatcatcggcagcaggatcgaaagcgcggccagcgccacgataaccacaagcccgatcattgcggcgcgatcctttttgagcgcctgccaggcatcccgatacaggcttcccgacggcggcgcacccgattccagcatccgacggtattttttatttttaggaaggtatcggttctgttccataaaagaccatccaatccgccgcttcgcatcggcataaagataaaagtggtttcaattatgccacagcggcaagcccctttgggcttgtctgccgcaaagcggcagcaaaaccggccttgccggtttggactatggtataattgcccatcaaaaggtggttgccgcgtaagcggcgatccgttgggtataaccccggtatcataaccgctttacggttatgataccttaatgatatctgacgcgtggatctgcggcagcatacagaacgtcgaccgccagattgaccagacagatgctcacggcaaggacgagtacggttgcctgtaaggccggcatgtccttataaaacaatgcgtcatacccatactttccaattcccggccaggaaaaaacgctctccacgatcattgtaccggtcaacagacggctcatatccgtaccgacaagcgacagcaccgggattaacgcattcttcagcgcatgtttccagatgacgcttttttcccgcagacctttggcacgcgctgtgcggatatagttctgaggcagcacctccaaaaacgctgatcgggaaatgcgggccatcattccggcggacggaatgcccagggtgatagccggaaggatgatatagatatcaaacccgccctgatagccagaaggtgggagccaaccgaattttacagctaaaacaagctgtaaaatcagtgcgaaccaaaactgcgggattgaaagtcccagtaccccaaacattgtgatgcctcgatcgaacaggctgccgcggcgcacagccgcgctcattcctaaaaacaagccgacaacgatgctgatcacttctgtcgtgacagccagttgaattgtttttggaaagacggtcagtatttcctccagcacaggacgatgcgtctgataggaccgtcccaaatctccctgcacaaggtccagaaggtaatttccatactgtaccaggatcggcttgtcaagccccattgtggtgcggatttgctccactgtagcctcgtcggcatattcgccggcaatcagcctggccgtgtcgccgggaatgacgttgaccagcaggaaaataaccagcgtcaacccaagtatgacaggaatcagggcaagcagtctgcggacaatatagcggggcatcaaagccaccccctttcattcttcatccggcattcccgcggaataaagctgttccgcgggaatgccggactgctccaacagctcttacttatcaagccagacacggtgataggtcgatacatccagggcactcgggcagtaatcccggacgaacggctggcagatgtcgacgtaaatattgtgcgtcaggtatgcatacggcagatcctcgagcaccaactgttcgatctgctggtacagcgacgcccgctcattgtcgtccgtagaagcgcgggcctgctcgatcagcgcatcaacctccggattggagtaacgggcgtagtttccggccgctccgatattgtcggaatgaagcagcggatagaacatggcgtccggatcgggatatgtcgcgacaatattgccccaggcgatttcaaactgtccagaatcgcgcgcctcgttataggcggaattctccagtgccttgatttcaatattgatgccgatctccttcagattctgctgatagatctccagtattttgatgttgttgttccatgcaggtgtgatgacttcgaaggtctgcggcagaccgtccgcataaccggcttccgccatcttagccttggccttttccacatcataaggcggtgtggtagccggatcgccggaaccgagcataccgctgggaagcaggacgttcgctacggaggcgcgcccctgaagcatgtcgatggtagcctgcgtatcaagcgcatacaaaacggcctcgcgcagcgccttgtttgacgcgaacggctccttttccatattgaacatcaaaaagctggtgtgcagcgtgtcggcgcggccaatgctgtttgcataacgcggatcgcttgtcaggcggtcgtaatgcgccggcgtgatccaggcaatatcaagcgtacctgcgtcaaattccacaatacgtgtattttcatcattaatgaccttaaacttgacgctgtcaagatacggacggcccgcccaataatcttcgaacgcgttgatcgtcagatcctggttaaaattccactgtccaacggtaaacggtccggcggctacaacatgctgtccaaaatcgtcgccgaattcctcgacagcttcctgtggaacaacagctagagcggccgatgacagcattgaaacaaacggcgcatatggttctgtcagagtcagctccaatgtatgatcatccacaaccttgatgccgctgatctcactggcgctgccggcggtgtattcgtcgaagccctggagcttattgagcatccatgcggctggagaagctgtctgcggattggcgacacgctcaaaggaatatttgaaatcctgcgctgtcaccgcgcggccattgtggaacttcgcatcgcgcagatgaaatgtccagactgttccatcctcggatggctcccagctctccgcgataccaggctcaattgcgttgccctcaggatttaaacgcaccaggccctcaaggatgtttgccgccacgattgtctggtcccatgcactcaaggcggccgggtcaaagcttttcgggtcggccgacgtataggtcgtcagcgtgccgccgtacttcggaccgcccgtctctcctgtttccgcggttccggacgacgcggccgaagcatctcccgcaccggaagcagcggcagaaccggtccctcccgctgcggagccgccgcatgcggtggtcaacagcatcgcgccgcaaagcgccgccgcaaaaagcctcgtcttgacagaatgcaacataatgatcctccttattatggcatctatggtattttccgcccatccggggcggcgtcggactgtgaatacaggtggcagcgcaccatttcctcaccgaagcttacaacaggagcaagcgcggatgagcagatctccatgcggtgcgcgcaccgcggatgaaagggacagccgtccggcagatgaaccgggcttggaacatcgcctccaagcgtctgttcaaaggcgccggataccgcgtcgatgtccgggatcgcctttaaaagcgcctgtgtatacggatggcgcggatggtcaaacagcgcgtccgaaccggcctcctccacaagctgccccagatacatcacgccgatacgcccgctgagatatttgacgacgttcaggccatgggcgatgaataaatatgcaaagccatgcctgcgctgcaaatcgcgcagcagattgatgatctgggcctgtacggaaacatccagcgcggaaaccggctcgtcgcacacgataaagcgcgggttgacgatcagagcgcgggctatgccgatacgctgccgctggccgccggaaaattcatgcggatagcgcccgtaatgctctttagaaaggccgacctgctccagaatttgaagcacacgctcacggcgttcctgcgcggaacagcccccttgaatgcgcaggccctccgaaacaatctccccgacagtcatacgcgggtttaaggattcatatgggtcttgaaacacaacctgaatctgccggcgcagctcccgccgcttttgccgggaacaggccgtcaggtctacgccatcgaacagcactctgcccgaagtcggctgctcaagtccgagcagcacgctgccaagcgtcgatttgccgcagcccgattcccccaccaggccatatgtctccccctcgcggatttccagcgaaacgtcgttgaccgccttgacgctgtccacctgtcgtaaaaacaccccgccgcggattgggaaatgcttgacaatatgctccgctttcacaagcggttgatcagtccgcgccatacgccgttccctccttttgctcctcaagccaacagcttgcgcggtggccgggacctacaacgatttccggcggctgctgtttgcagcggtccgtcgccgcgccgcagcgcggcgcgaaccggcatccctcgggcatttgtgaaagatccggaacattgcccgggatcaccggaagatcctgcccacgctgtgttgtcaggcggggaatcgatgcgatcagaccgcgcgtataacaatggcgcggatggtcaagcacttcacgggtcggtccctcctccacaatctttccagcgtacatcaccacgacccgttccgcaaagtttgcgacgaccccaaggtcgtgcgttacaatcacaatcgacattccgagctgatcgcgcagcgtgcgcagaagccccaatacctgtgcctgaatggtcacgtcaagcgcggtggtcggctcgtccgcaatcagtatttttggatcgcagcaaagcgccatcgcaatcatcacacgctgcttcattcctcctgaaagctcatatggataacagcgcatccgctgttcaggctccggaatgccgcaaagctcaaacagatgtatgatacgttgtttgcgctgctccttcgacagttttgtgtgggcgcgcagcgtctcgtccaactggttgccgacggtaaaaacgggattgaggcttgtcatcggctcctgaaacacaaacccgatctcgccgccgcgcacctgccgcagctcgtcggagggcagccccacaagctcccgcccgtcaaaaacaatgctgcccgttgtcacagccgacgcgccggccagcccgatcaccgacaagcatgttaccgtcttgccggaacctgattcgcccacaaccgctacgatttcacgggggaaaaccgaaaagccgacatcatccacagccggcagcagcccatgcgccgtttggaaactcgttgtcacatgtgaaagcgtcaaaacaggttgttccttcgtcatcaggattctccccccttaccgcctgcaaccgacggcatacattcacgtatgaattgactcaattgcgtcctgtccattggatagatctcggctggcggaccgctttcagtcagcatccgttcagccaaagccatgaactgtgctgtttcaactccggcgcgttcctcctcgctcacggccatatcatgcatctcgcacagcttgatccgctcggaaaatccgatcttcaccgcgacaggtacattaacacgccggctgaatgtctcaataagagcatcctcgcctgtaaagcgccgttcctgatatatcagtcctctgacacaggcgccaaggccctgcatacctgcaagaatattattggccgcgaacagcgacgcctgttcgcccgatgtcacaatatagagttcccgcgcatacccctttgtaaccggcgttgaaaagccgccgcacaccacatcgcccaaaacgtcgtacagcacaacgtcgacacggtcaaaccaacctgctttttcaagcgcgttcagggcgatcgcgatgccccgccccgcgcatccaacgcccggtttcgggccgccggcttcgcagcaccacagattgggccgcgggttggcgatcagcccgtcctgcaaagacggcccgcacggcccatcgtaccgctccaaaatggagatcagcggctgctttgtcaaaagacgtgtcgtatcctgctttggatcgcatcctaccagcagaacccggtacccgcgccgcgccatgcacagcgcggtattgaccgccacggtcgtctttccgatgccgccctttccatagagcgcaatccgctttttcatggcgccccctccgcaagcttcagcagccgattcgcaatggtcagtgcgccctcgtatccaagcagtgcgccaattggttcttcagtcctccaaacaggggcaaaaaaaggaatatagtcccagttatcgtcagaacgaacattggatgagccgaatacaagcctggctccaaacgctttcatcagctcgaccagctcccaccggccgacatcctcataaaattcctcgcatattggacgctcgggtttctttgggtgcgcacgatccacacagagaagtacacggcagccaagctcattggtgaggaaatccgccaggccgtagccataccagccggccgcctcaatggcaacgggaaccgcatgagagcggagcttttgcgcgagcggttcaagctctttcacagcgcggtcatatgcatccaacccatgcggcgtcagtccgcgtcgtccagtctgtccagccagccactccaaaaaacgcctgctccccgccgcgccgaacggcgcggctgagtccggctccgaccggcgccacaaaagcccggtaaagactttgcccgccacacggtaatccgcggacagctccggcagggaaatgccggaaaaaagccctggtgtgacacggcatccaatcccggtttcaattaattcccaaagagccggaaaattgtccctgcggttgtaatccgtcagcggaagcccttccaatgccaggaattctccgctggcggccggtacgatcctcagctttcggtacaacgcgtcataaaccgcgccgggcgcgtccgtctcatcgcccgccaagccgctgccgtccagcaaaacagcggcgccgccggtttgcctttcataatccagcaggatgctttcatattcctcctcaacaagactggtggcgcatgtcaggatcaccgcgagcagacccgggtgatactgccgccacgcttcgatcagagcctcccgcagcttatcgcgcgcgcccagcgccatatccctttccactacggccgttgtcggaagaagcggctccacatctgcgtagagcatcgccagacgatggccggaggagcagctcaccggtccatggatcaacgggagtacgccagggatgccggccaagcacttcagtatccccaagatcccgcatccagtcattggttcgagtcgttcgatggacatatgacgccctctacctcccttgctataaactggctttccgtgaaggaatagcccgacatcgccagcagcagcttgtttccaaggttgacagccccctcaaagcccacatgcggaaccgtgtaaacggtgatcgggacgaatgggatcccatgccgcttgcaggtgtgctgctcctgatagccgccgagccagacatccacgtcgtattgacaggcgacgcgctccagatcatccagacctggcgaaagaatgaattccttcattttaacgccgtgatcccgcagcatgtggcggatatcctcctggctccacgcatgaggccagaacatggctgccgcctggatatccatcccatagtcggccaatgtgtgcagcaagccgatcaggcggcccgggccgccgctgacaaaaaccttcttgcccctgagctgctcccggttcttctcgaacaagtccctgtaccgcttttccatcgcgtcgatgccatcataaaccggcagctccaatacatccgcaatgcttgtgagccattcgcgcgttccggaaaagccgtacggcgcgcgcggccccgcaaggcgaatcccctcctcgtcaaggcgttggagcaagttccccatcaccgacgagcagacaagcgcgttcgcaccggcgtgcatactcttttcaatgtccgccagggaggaaccgccggaaatcaccgcattcaccggaatttgaagctctttgagcatatcgatacagcatccgatttcatgtcccctgtggcgcgacggccacatccagcccaccaggttgaccgatttttcatgccggtaggacttgccgagatacggacgatagagagcctccagagcggcgtcgtagcccgcccactgattgggactcgacatccccgcgatttccagagcctcggtctgaattccggtgaatttttgaatctctcctgcaacgcctgcaaggtcggcgccgcacagaagcagcgcgtccgtgggcaaaaggacgatccgtctggctctatagacgccgcacaactttttcatgcggcgaagccagtcctcaggcggggtaaaatcgcccagtgcaatttgctgctgccggtactccagcacgggcaacggacgttttcccaggaaaaagtcgatctctccccacgccacaattgtaaaattgagatgatacgcgcagcctttggcgcctacgatcaccgtcagcacatcgtccattgtcataaacatgcgcagagccgcaaacatgggaccgagcacctgataatccgcccagaaagccgactcctttgcggcgtcctgctccaggaacccttctataccgccgatatatttctgcatatgtatacccttcttaacaaaacacccaagctcacgtcaatatgtgacgatccgtttttcatccaaaatctcctgctgcacctgacgaaccaggccggaagtcagcaccagactcaacagatcggacaggttgtgatcgctgccgcgaaccgcgaccacactttcacccagatctctttgcatctgtggcggcaagtgctctatgggatgaacgtcaaaatcatccgcgcatcccagactttttcgttccacgagcgcggactccacttcgccgcgccgcaccagctccggcaactggacgccgagacattcgccataacggttgtgctgctttcccagactttccataatggctatctggtcgtaggagaatgcgtcgtatgccacctgtgtctccgccatggagaatggcgcgtccctctttgtgataaatacatgctcgcttggatagccgctgatcgtaccgatggaacaaagatcgcggcgctcgtcacgggcattcttgtgcatatatgaatatgcgcacaggctcatcacaacaaagtcgcacttttcacgcagcaatattccggctcggttacgggatccgcgggcgaacaggatatgaatcggcaggcggtattcggtgaatgcttcgaaaataccggtagccattcctttgacgcacaggctgctgtcgagcgggagcagcccgataaaaatatcgtactcgcacatctccaaaaggcggctgcggtcggcgctttctatgtatgttccctgtgcgccgcaggcctttagggaaacggctcccgcggccttcaaatcagccagcgcaccctgcaccgttcccgcgccgacgccgaagcggtccgcatattccttgatcccggagagcttgttgttttccccgcggaaaaccatggtgataaattcacgcgccagggctcgccgcaccgcgtcctgcttgttggtcaaccctctcaatacgctccccctttcgtataaaaacaatatacagttttctgtaatctaagggtaacactttattttgttcttgtcaaccaattttactaaattcattttgagatttgacaaaaaataaataatattatataaatctactatccgtttacacgttgggaggtcttttcatgcccaagcagttatctcataaagtgatcgttctctctttggatgccatgacttttgaggatttttccaaagcccgtgacctgccagggttttcatggttctgggaacgcggcgcgctggcgcgccatatccgaagcgtctatccgtcgctgacctatccctgccatgccgccatggcctgcggctgctggccagaggaaagcggcgtgtttaacaacgaattgtttttgcctgaaacccgccgaaggccgtggatcttctatcacgatcaaattcgccgccccaccattttccatgcggcgcgcgcggccggcctgcgttccggctgtatcctctggccgtgcatgggaaacgcccctgtcgattatctgatcccggaaatttgggacggcgaccccgacagcggtttttttgaaccaatgtgcagggccggcagcgcgccgttcatccgcgaaatctggccggaggtcggttccatcccgcgaggcttccaacagccgatgcttgatgaatttgtttttgcatgtttgcgccgtgtcatccatatgggcaatccgccgctgatctatgcgcatgtctgccagatcgacaacgccaagcattacggggggcttgactcgacgcaggtatgggaggctgtcaagcgcacaggccgtcttttggacggcctgctgcgtgagcttgacgctctcggaatcctggaggagacaacggtcgcactttgcagcgatcatggtcaactccctgtcgaccgcgcgtcctatccaaatgtgctgctgcgaaaacgcggatttctgacaccggaaacgggatcggacagcttgcattggcgggcgcagtcgcattcggcctgctgttctgcacaggtctatgtcgccgacccatcggatgttcccgctgtccatgccatgttgaacgacgaaagaatacgtgagtacctgggcattgcggctgtatatgaccgcagccaggcaaagaaactgttccatctggacgggccgttctcgtttgtgctcgagggggcgcccggcgtactgttccgtgatgaatgggaaggggattccctcatgtgttccttaacggacgcgggcctttcctatcgggccaaccacgggcacgaccccgcccgcggtcaatccccctttttcgcgctgaaaggtcccgacgtccggcagggcgcgcttgtggaacaggccgacctgatcgatgaaccggtcacaattgcgcgtctgcttgggctttcgatgccttgggcacagggaaagccgcttgacgctttgctgacaacaccaaggtaatacgttccatctaaaaagggcatggcgcggataatattccgcgccatgcccttttttgttcctactcaatcacggtgtatgcttcggcggccgtgtcctttgtcgcatattcgctgaccttgacgacctttactttcagcggcttctgcccaagattaatttcgatgacgtcgccctccttcacatcgtaggaagcgcgcgcaaccttgccattgaccacaatgcgtccagcgtcgcaggcctcattggcaacggtgcgccgtttgatcaagcgcgtcaccttcaaatatttatcaagtctcacaaaaaatcctccgtcacagaaacagacgcatgtatggcaaaagcctgccgcgaagcggcaggccctcacccccctgcatgtggctttttaccttacttgccggcgacagcatccttgagagcttttcccgcgctgaacgcaggaactgtcgccgccgcgatcgtaatcggcttctgggtgatcgggttgatgccctggcgttccttgcggtgctttgtctcaaaggtgccgaacccgacaagcgcgaccttatcgcccgctttcagtgcctcggtgatcgtctctacgatcgcgccgacagctttttcgctgtcctttttagaaagtcccgatttttccgcaacagcggtaatcaattctgctttcgtcatttttaaaagccctccataaaataaatatatcttcagacattaaatgcctggacaaaacgctcatcgattcatacgcttcgcttcacgccaaagctcgtccagcttttcaatcgacgaagctttcatatcgatcccccgctgtgcagcgagctgttcaacgtttgtaaaccggccgataaacttattacaggcgcggtttaagctctcctccgcatcaatcccggcaaagcaggaaacattgaccgcggcgaacagcagatcgccaagctcctcgtcgatatgcgcggcggcgttttccgcgaccgcctcccgcagctcgtccaattcgctggcaagatcgtcaagcgccatcgcgccgcttggataatcgaacccaaccttggccgcgcggtgctgcaccttctcgctgcgcatcagcgccggaagcgccgggctgacgcttctaagcgtctcggccgccgttttctgccctttgctctcctgcttgatccgatcccagttaacgagcacatctccgctccctgaaacctgcgtatcgccaaatacatgcggatgccgcaggatcagcttcttgcagatgccgtcgcagacatcgtcaaagcaaaacgagcctgcctcctcctccatgcgcgcgtgaaacacaatctgcaaaagcacgtcgcccaattcctcgcgcagcaaatccgtgtcctcgcggtcaatcgcttcgcaggcctcatatgtttcctcaacaaaatttttgcggatggaatggtgatcctgttcccggtcccaaggacagccttccttggaacgcagtatttccatgatgcgcagcagatcctcgatcctgtaggacgccttgcgttcaaaagcggccggcatcggcgcaagcccccttttcaagccattttagcggtacttaagtattctaccctaaaagggaccgcttttcaagtagctttgcaaacttttctccgcccggcagcatggtaacgtcctccttcgttaatgtccgtgtcagcagtacaaccgccagatatgtcgcggcgccggccgccaccgctcccatcgtagcgatcgttcccccgcaaatccgctccagaaggccgtttgcggcccatgcggcggctccgcagcaaacggcggcaaaaagcggtttcccaaaaacagggagcacccggatgcgcacgctggtcaaatttaccaaccgggacaggctgacaaaaagcacaaaacagtagcagacaagcgtcccgatgggcgcggcctgtatattgagctgcgggattgcgaccaaaacaaaattgagcgccaacttcatcagcccaccggcaaacagcagtttaaccggcaggtcggcgcggccgattgcctgcaaaatggcattgaccggcagcgaaaccgccacaaagatcgcgctgaggcccataaaacgcagggcaggcgcgattacagccgcctccattggcttggagaaatataagagccgcatgaccgggccggcgagtacgcagataccgataccagccggcatcgcaatgagcgatgcgatccgcagcgccgacgcagcgttctgctcaaacacgcgactgttgcgcgtcgcccaagcggcggaaacagcgggcagcaggctgatgccgatggtcgctgtcagggatggaaccaggttataaaccggaaccgcaagacctgagtagcatccatacagatatgaagcgagcattccctgatcgacgccggccggaatcatgccgtcatacatgccccaaacagtttgcggcgcgcgcccgatcgccgcggtcaatcggttcatcacggaaatcagatctataaacgaggtcagattcgcgattacggacgcaacacaaaccgggatcgcgatcgcggccagcctgtgcagcagctctccgcccggcgcaggcggcggggccgccttatccacacggacgcgccggcgtgtcagcatataaagcgagccgcacgccatactgagcgtcacgcccaggatcgcacccgccgccgcatacggaagaaccgcaatctgcgcctgctcggcggaatcgcacggcgccccgaatacggtgccggcacgcgcatattcagccattcctatggctgtcgccgcgtatgcaagcgtcagtcccagcacaagctttgccactgcctctacgacctgcgagacggccgttggaaccatattctgcatcccctgccaataaccgcgcagcgccgccatcacgcagccgaaaagcagcgcgggtgaaagcatacgcacagcgagcgccgccggtggattgttgacacgctgggaaaaccagcccgccccaaaatacatcagagcggaacccacgatcccaattacgacaaaagcgcctacagacaagcgtagcaatttttccgcgtcgcgcgcgcgtcccttggcgacgctttcgctgaccagcttggaaacggccaccggtacgcctgaaacaaacagcgcgtaaagaggatagtaaagctcgtaggcgacgttgaaatagctcataccgacgccgccgagaatatttgtcagcgggattttgaaaaatacgccgatcaacttgacaatgaccgtcccaaccgccaataccattgtgccgtaaagatagccatgtccacggcgctgttccatgtatccacgctccttagctttccccgatatgcgattctgttgacagagtctgcgttttacggcccttcccatgtcaacagctcctattgtgtcaaaaccgggcagaaacattcatcaaacgcgcggctgccgccgtgcgtcattacacttatattatcacatgcgccgcattatgaccagcctggccttgcattcccatggccaatccgataaaatagatttattgtaagcaatcgacgggaggtctatttatgaaaaaaatcggtatcatctgcgcgatggacaatgaattcgcgcttatcaagcaggccctggcccatgggcgcaccgcgcagataggacgctgcacgttttactgcgccgaatatgccggcaaggacattatcgcggcgacaggcggcatcggcaaggtcaacgcggcggcctgcgcacagatgatgatttccaatttcggtgtcgaatgcatcgtgttcagcggcgtcgcaggcgcattatcggacaagctgcatatttttgatatcattgttgcaaacgatgtcatgtatcacgacctgttccccgcctctctgctcagggacaatttcccaaactgtgattgtttccccacggacgcgcggctcgcggagctggcggaaaccgtctgcaccgaactgaggctgcattgtatccgcgggcgcgttgtatccggcgaccagtttatcaccgattcctctgttaaaacgcgtatcatttccgacacgcatggcgacgcgacagagatggaaggcgcggcggtcggacatgtctgttacctcaacaatctgccgtttgccatcctgcgctgtatctcagacggtgcggacgacaacggagagatggatttcgacacctttgtcgaacaggcggcgcaccgctgtgccaaactgacgcttgggctggccgaacgcatttgagacaaaagcccctcacgccgcatttacagcggcgtgaggggctttttagccatcctccttcaaggcgtagtcttgagcgtgctgatctgcctgtgatagattctccggtacatcacaagcgccagacaaagcgaaaccatctccgcaatcgggaacgccagccaaaccgcgtccaggctcacaaagcgcgccatcacccaggcgaccggcagcagtatggccaattgacgtgtcagggacataatcaagctgtacatcccgtttccaaccgcctgaaagacagatgacaacacaattccaaccgccgcgccaagaaagcttaagctgatcagcctgagggcgggaacaccgattgccaccatcgcgcccaacgactcctccgaggaagcgaacataccgatcatctgcgccgggaaagcaataaacacaatcataccggccagcatgattgcgagcgcatagatacacgccaagcggatcgcttttataatgcgctcctttttgcccgcaccaaaattatacgccacaattggaatcaatccgttcgtcagaccgaacaccggcataaatacaaaactttgcagcttaaagtagatgccgaacaccgaaacggccgtctctgaaaatacgatcagaatcttattcataccgccggtcataagcgttgctatcgactgcatgacgatcgacgggacgccgaccttgtaaatctcacgaacgatgcgccaatttggacggaacttcaagaaattcatacgtacttcatggttaaacagatgattaaacagcagcccgagcgccattgcgagaatctgacccgcaaccgtagcgacggcggcgccctttacacccatttcaggcataccgagcaagccgaaaatcaaaattggatcgaggattatattcgtaatcgcaccgatgccctgtgtgatcatattaaagatcgtcacacccgtagcctgcataatacgctccgttgcaagctgcaaaaaacagccgaacgagaatacgcagcagacgcttagatactgcgtgcccatttcgacgatctccgggttagaggtaaacatgcggaaaaagtcgtcggaaaacaaaccgccgacaatcgcaaaaacaatccagctcaacactgcgagcaaaatgccgttttcagcggctgcgttggcgtcctcgaaattgcgttcgcccagccgccgtgacaataatgaattgatgccaacgcctgtaccgaccgctacagcaataatcaggttttgaatcggaaaagctaaagacacggccgtcagagcgttttcactgattctggagacaaacacgctgtctacaatgttgtatagcgcctgaatcagcatcgataccatcaccggcagcgacatggataccaaaagctttccaacaggctgtattcccattttgttttcttttcttgcttccatactcccatcctttaacaaaagctgtctatatatctgtacatctcaaacattctctttgctgagataaaggcccggatggttcatccgggcctttcatcgatccgtttactcctttggctcgtcaatggccgccgctgttggcgcctgtgcatcggtcgccgtctcctccggcgcagcttcctcattggcttcgccgctgtccgcaggcgcagtaggcgactgccccttgagcgacgcgccgcagtgcgagcagtagagcgcatcgcgcggattctccgacatacagtccgggcagcgcaaaaccttgcgcatctcgtccagcttgtccttcagctctgcaagctctgcgagttgtgtctcaatctcggcaacgcacatcccgacaagttcctcattctgtgtgccggacttgttcagctcatagataatttcgccaagcttgagataatttgcgtcgatctggcttttcatctgcgtaatctgcatgcgcagttttgcctgctccgcaacctcctgcgccttgctgccggcgacccccgccaaatcttttgcctttataatcagctcgtcaaattttcccatgctgaaagcctcctatcctttgaattagtatgcattatacaccatccgtccgatatttacaagccgctgtcctgataaaacaggcgtacgcgctgcttgcggcgcagcgcctcgtcgaagcgccccatatactcggtcgggtgcttataattgtatacccgctcgatcctgcccgttttcgggtggcgcagctttgtcgaagcgcccgcgccaacagcaagaatcgtatgtgtttcgtccataatgtatgtattgtaaaggccctctgttcccacagcggcatagccgacgttctcaagactggccagcgtgccagtttgacgatagaggtaatatggatgcagaccggccgcttcacatgcgtttcgggcatagccgaccatgccgccgacaagctccagctcgccgcgcgcttcgtcaaaggtcagccgcgacgcgcgtttgaccgtcagcgtatggacggtgacgttttccggatggagcgcaagcacaccgtccacgcttgcagcaaagccctccggcgtatcggcgggaagtccggcgatcaggtcggtgttgatacagtcaaagccagcagcgcgcgccattgcaaacgcttcaaaaaactgtgccgacgtgtggcggcggccgatggcgcaaagcactgtatccgaaagcgtctgcgggttgatgctcacacgccgcgctccgccggcatagatagcgcgcagcttttgaggcgtgaccgtatcgggccgtcccgcctccaccgtgtattcccacagcccggacaggtcgaacctgtctgcaaccgttcccatcacgcgagtcaaatcttcggctgacaacgttgtcggcgtcccgcctccgaaataaaccgtgcgcagacgcagccccaactcctttgccagacagcctgtgtattccagttcctcgcagagcctgtccacatacgcgggaatcaacgccgcgtcgcgttcgaccgactgcgaaacaaacgaacagtacgcgcagcgtgtcggacagaaaggcacggaaacatacagcgaaaagctgtcaggcgttgaacgggagagcagcggctgttcaatacgcgctgtttgcagcgcgaggtcaaatttttccccgctcacaagactgccgtccataaaccgcctgcgcagcgcgccgtcgtccgcgccgcgcataagctccgtcatgaacagccgcacggggcgcacgcccgtcagcacgccccacggcggacagacccccgtcgcccgcgacagcaggcggtacagcatcacgccaaacatgtgttccatttcccctggcgtgcagcccggcgcagccgtttcctccggcgcgctgtgcagccgccccgacgcctcccgataagaaaccgtcagcacgccgccgcacagacgcgcgccgagggccggcgcgccgcagggcgcgccctcctgaaagacgaccttctccccgggaaaaaacatctgcgcgacgcgcgacaactcgtagccgaacgcgtgcccctcaataaaaagcgtcatagcccggtttcctgttgatgtatgggttgcttctgcgctcgcgcgcaagcgtcgtttcaggcccatgaccgggcagcacgcggtaatcgccttccagcttcgaaagcttttgcagcgatgccatcatttcctcgtaatcgccgccatacaagtcgatgcggccgatatctcccgcaaacaacgtgtcgcctgtaaagagaacgtcgccgcaccggtaagtcacgccgccggccgtatgtcccggcgtgtcgatcacctcaaatgtcatgccgccgactgtgaccctgtcgccctcatcgagacgctcgtcgggcgtcaggatgtagtcctcatcagtcatgccgcgcatgatcgccaaactttttttgcggtcggccagcatctcctcgtcgccgcgcccgatcgccagcttgcagccgaatgtgtcgcgcagcgcgcgcaccgcgccgatatgatcgtagtggccgtgtgtcagcagaatatattccggccgaagcttctgcccgcgcagaaacgaaatcagcttttcagcctgaaaacctggatcgatcacagcgcagacatcgccgtccgccgcgatataacagtttgtgcccatcgttccgacaggcatggtgtatactttcatgattgcttctccttcacgatttgggtcctgtttgaacggaacgatccggctgttttcctttcaaaccttccctggccgcttcatgatttcatcggtgtcgaggatgaccgtcaccggcccgtcgttttcaatggaaacgagcatatccgcaccaaaacgaccggtctgcacagacgtaacacccgtgtctttgaccgccgccacgaaccgcagatagagcgaatcggccgttttcggctcggcagccccggtgaacgacggacggcggccgtggcgcgtatcggcgcacagtgtgaaatttgagacaacgagcatcccgccgccgatatcaagcagagatcggttcatcttcccctgctcgtctccaaaaatacgcaggttagccgccttttccgccagaaaatcggcttcctccacgccgtcgccgtcgacaacgccgagcaacacagcaagcccctgaccgattttcccgacgacctcatcgccgattctgacggatgcagacgagacacgctgcaaaactgccttcaatcaaagccctccttccagtttattccggtgtctcactgcgcagaccgtgtgacgcgctccacaccgggaatcttcttgagattgttgataataaaattgagctgatcgatgtcgctgacggtaaatgttaccgtgacgacgttctcgcctgtttttacttcgcgcgccatcagcgtgctgattgaaatgcgcatcgaagaaagagcgacggagatatcggccaaagcgcccaagcggtcgtccgtgacaatttcgattgtgctcttgaagtgctcgcgcttggcctggtcgagcgcccattcggcgcgcacccaacgttcggcgttgtttgggtcattgattgaattgatcacgttggggcaatcttttttgtggattgaaaccccgaatccgcgcgtgacaaacccgatgatctcgtcgcctggaagcgggttgcagcagcgcgcaaatttgaccaggcaactgtcaagcccttccacgatgacgccgcccgacgcgcctctgacacgatgctgcttaacaggcgccgggctgggcgccgcgtgcgggtctgtgcggtacatgcggataaacgtttccttgatgcgcggcatgatttttgaaagcagcacgccgccatatccaatggcggccagaaaatcgtcagcaagctcgaagtgctgccgcttggcgatcgccgacaaaaactccggcagctttccgtcgggcagcgtgatcatattgcggcggaattccttttcaagctcgctgcggccctgctcgatgttttcctcgcggcgttcctttttataccagttgcggatcttgttgcgcgcctctgtcgttttgacgattttaagccagtcgcggcttggcgcatgatccttcgcgttcgtcgtgacaacctcgatgatctgaccggtacgcaccggcgtatcgagcgcgacaatgcgcccgtcgattttcgcgccgaccatccggttgccgacctcggtatgaatagcgtatgcaaagtcgatcaccgtcgagccgacaggcaggctgatgacatcgcccttcggagtgaacacaaatacctcctcgggcgaaagatcgcttttaatcgaccgcacaatatcctctacgtcgtcagcttccttctggttttcaatcaactggcgaatccacgcaagccgctcctccagcttgtcgcgtccggtgacgccggctttatacttccagtgcgccgcgatgccgtattcagcggtgtggtgcatatcccaggtacgaatctgtacctcgaacggtatcgcctccttatcgatgaccgtcgtatgcagagattgatacatattcggcttgggtgtggaaatataatccttaaaccggtttggcagcggccggaacaggtcgtggatgatgcccaggatattgtagcattcattgacagaatcgacgataatgcgcactgcataaatatcgaaaatttcttcaaacgcttttccctgaatatacattttgcgatagatgccataaacgctcttaacacgtccatcgacataaatatcgttgtattctgccgccagccgctcgcgaattttatccttgatcttctccaaaaagctttggcggtcggcgcgtttaagctccagcattgattcaatctcatggtaggccacaggatcaagatagcgcagggagatgtcctccaattcctccttgactgcccggataccaagccggtgtgccagcggcgcataaacctccatggtttcaagcgccttatcgcgccgcttctgttcgggcatcacctcgatcgtgcgcatattgtgcaggcggtccgccagcttgatgatgatgacgcgtacatcctgcgccatcgccaaaagcattttccgcacattttccgcctgctgctcctcgcgcgatgtaaagctgatctttccgagttttgtcacaccgttgaccagcagcgccacatcggtaccaaactgcttttcaaccgcctcgcttgtgatatccgtatcttccacaacgtcatgcagcagcgcggcctggatacattcgctgtccatacccaggtcgacaaggataatcgcaaccgcaatcggatgcgaaatatacggctcgccggaaacgcggcactgcccattatgagcgtcattggcaagctgataggctgccatgatcttttcgcggtcatacacgcggccgctccggtcgatcgcccgctgcaaatcgtctataacatagtaattcatctgacaaggcctccattgcgggccgaagcccgcagaaggggcgtcattcacgccccgcggcgggctttgcaagcccgcgcagaatcttggattgggagatatccaccttgcgcggattggccacaacggcgacgttttttgtgcccccgctgtgttcccgggtgatcaaatgcatttcatcgagcacatcgattgcgatcttgaccttacacaggcacgaaatattgccctgtaattttgcatagatcatttcatccggcgcgcgcagatttccttttgtacgcagataacggtataccaccgcaatatcctcccgatcgggcactgcggccgcccgcgccggcggctcgaccggctcgctgcgcacaagacgctggtacacctgttcggaatgatggattttatcatagtctattccggaaaggtggatatcgcgcaccttgacggaaacgcgctgctccccattccattcatttacatcaaccgtaaccgccaaatccactgtttcaccgattgtataaggaaaattggcctgcgtcataccaaagtaaacggcataaaatacacatccgtccccacagaaacgcagccgtacatgcttgccgtcgccgattgcataaattccctgcaaaacacagctgcggattgtaaagacaggcggttcgtttcctgagccaaacggctccagcatagacagcggcgcgatctcctcaactgttaactggcgcggcgaaatagcacagtcgatgttgattgtctgctgcggcatatcgggatagtgagaagccgcccaatcgttgattgcatttttaaacgccttgagatttgccattgataccgtcagtccggccgcctgattatggcctccataacggatcaaaagccgcgaacaggcgtcgattgcgtcaataatcgaaaagccttcgatgctgcgcgcggaaccgcgcgccacatccccttcaacagaaaaaacaatgcagggcttgccgaaccgttccaccatacgggaagcgacaattcccacgacgccgtggtgccagccctcgccatggatcacaatgatacggcggccaagttcctctgtctgcgcatcaagctggttcattatttgccgcactatctgatcctcgactgcgcggcgcttctcattgagtgaattgatgtcgccggcgagtgtttccggctcgtcacagccgcccgaaaaaagctcgacagcattgtcgacgcagtcaaaccggccggctgaattgatacgcggcacaatcccatacgcaatattttcacacgacaactgccggtccgccatgccgcaaacgcggatcagcgcggccaagccctcgttatccgtgctttgcaggctttccagaccgcgccgtacaatggtcctgttctcgccgatgagcggtacgatatctgcaactgtggctacggcgatcagatcgccatactgctcaagcatcaaatcaccatcgtcgccctccaacgcacaaataagcttgaacgccacgccgattccggcgaggtattcacagccgctttcatcgtccaggcgatggggatcgacaactgctactgcctgcggcagcatatcgcgcggtttatgatggtcggtgacaacaacgtctatgccgatggaggcggcaaaagcaacctcgtcgacagctgtaattccattgtcaaccgtgatcacaagccgcacaccgtcgtcacgaatgatctgcaaagcctcgcggttcaggccgtagccttccctgtcgcgatgcggaatataataacaaacgtcggccccggccgactcaagataactgtaaagcacgacggtcgacagtatcccgtcgcaatcataatctccgtaaacagcgattttttcaccttctgcaatcgcccgccggatgcgcttcaccgccctgtccatatcgcgcagcgccatcggatcggtcagggcgcaatcccctgtcaaaaaccgcctgattgcttcctgtgtatcaaagcctctgccagccaaaatccgaaccgccagcggcggcagtccaagcgccttcgctgcatgccgcgcggcttcgtcgtcggcctgccggatattccagcgtttgatcggcacatcgattcccccgtttatgatacgcccccgcgcggcggcgcgcccaggtcatatcatcaatatgaatgaaatgattgtaccacttttttgcataaaacacaatatccgcctgcaagccttctgatgtaagcgatgcgggcaggaacgatgtttcaaatgatacacagccaaaaacgtcaaagcggcgcgggaaaacccgcgccgcaaaaaatctgtttcgttttacgcctcagaaggaccggcctcatagacgacgccggattcctcattgacaggctcctgcgcttcttcctgctgcttcttgtcctcgttcagcgcgcggatcgacaggctgacacgcttcttttccgtatcaagctcggtgatcttgacctcgacctcctggccgatcgaaagtacatcggagggcttattgacgcgctcatttgaaatctggctgatatgaatcagaccgtcgatgcccgggataatctgcgcaaaagcgccgaacggcgtcatggagacaaccttgaccgtgcagaccgtaccgaccgcataatccttcttcatgatttcccacgggttgtcctcggcctttttgaagccaagagaaattttcttgttttccgcgtcaatatccttgatgtatacatcaaccgtgtcgcccacattgacgacctcggacggatgcttaatacggtgccagctcaactcggaaatatgaaccatgccgtccacgccgccaaggttgacaaacgcgccgtagctcgtgagcgatttaacgacgcctgtataatggcgcccgatctcgacctcctgccagaacttgtcctcaagctctttgcgctgctcgcgcagaacagcgcgaatagaaccgaccgcacgcttgcgctggcggttgacctcgaggattttgaagttgaccttctgcttgagcaggtcatcaaggctgtcgctgcgggacagggtcgcctgcgaggcgggaataaagaccttcacaccgttggtcaaagcgagcacgccgcccttgatcacctcgacgactgtaccctcaaggatttcatccgtatcgacagcgttcatgaccttctcaaagcctgcaatcgcgtcgagacgctttttggagagcataaccgtgccttccacatcgttgacgcgtacaaccagaaggtcgagcgtatcgccgaccttaacaagatcctcaggcttcgcgttcggatcgtctgtcagctcggacagcgggacataaccggcgtgtttggtgccgatatcgacagaaatttcattcggggcgatccctgtcacaacggcagttactttctctctgttatctatcgtcttaaaagactgattcaacatctcctcgaaagaaagctcgtcctgatcccttagaatctcactcatggttttatgtacctccttaataatccacgccggcgtagacgctccggctgtgacgccaaccctagtatgcccgttaaagtcgcaatcatacaattcctttgccgattcgactaaaaaagtttcgcaaaattccccacaaatctgcgcaagcttcacggtatttgaactgcggcggccacccaccaccaccatcgcatcgttttcggcggccaatttccctgcctcgcgttggcgtctctcagtagcaatacatattgtatcaaatattcgaaggtttgtacacacttttttaagtttttctacacttttttcccattccgacactgaaaaagtcgtttgtgaaagtaaaacaaaggctttatttctatttttttccaaaaatggatacaaatttttaagctcatcagcatttttaaacgtcaaatggcgctcacagaaaccctcgattccctgtacttccggatgtgaaggatcaccggcaatcaaaataatgctgtcttttgcgtatgccgcggccagcttatgtatcttctgcacatatgggcaggtcgcatcgacgacctcacagcccatttcagccagcgcatgatagaccgacggcggcactccgtgcgatcgaataatgaccgcacgtctgtctatattgtcctctacacgctcaatcgccggtatccctgccttgtaaagtttagctacaatctgtggattatggatcagttcgccgtaagtacaggcgggccggccggaccggaccagctccatcgcaagatcatacgcacgctgaacgccaaagcagaagcccgccgtccttgcaaccgttacgctcatgcctgttcctccagaagcctgacaatttcatccataatcaaccggctggcggctttgatttcacgcggcgcggcgttagcctgtgaaaaaccaaggcgctcatacggaatcagcgggccgtagcggatggtgagccgtgtacgaaagcgcagttctttcccatagcatacggcgcatggcagcacagaagcgttcgtctgtgaagcgatcatcgccaccccggacttgggctttcccggcgtcccgtcctttgagcgcgtcccctctggaaacatgcccaggacggcgccgctgcgaaccacttgttcggcccactcaaccgcgcctgtgtcgcccttgccgcgttccaccgggaaggctccaagcctgtggagcagccaggaaaacagtttccccttctggaacagctccaccttcgccatatagcggatcggtgcgcgcacgccggcagccacaaagatcggatccatatttgtacggtgatttgcggccaggatatagccgcgatcccgcggaacattttcgcgcccgacaatttctacatgatacatcacccggatccagatcatacaaagccaccagcagaaactataaaacatgggcaagctgctccttcacaagttttaaaaggatatcgatcgaccgttcaagcgtgttgccggtggtatcgaccagtaaggcgtcgcgcgcctgtttaagcggcgcaatcgcacggtttgtatcgctttcatcacgctttcggatatcctcaagaacctcctcatatgtgacggacctgccctttgcggtcaactcatcgaaacgcctgcgcgcgcgatcctccacagacgccgtcaaaaaaattttgacctgtgcgcgcggcagcacgaccgttccgatgtcgcgaccgtccatcacaacattgtgctccattgcaaggttctgctgaagcgcaaacaaaaattgccgcaccgccggcagcgcgctgacattgctcgccgccatggaaatttccggccgccgtatttcctcggaaacatcgtatccgttgaggtatacgcgctgcgtcccgcttttatcgtgacgcagctcgacctttgcgctcataagcaatcgctccactccggcctcgtccgttgtctctatgccgttggcggtggcatatagcccgaccgcgcgatacagcgcgccggtatccacatagatatatccaagccgttcggcgatcgcgcgtgcaatcgtactttttcctgcgccagccggaccgtctatcgcgatagaaaccatgcttctttactccctttatccattgtcggccgcagcaatggccgcagccgcgagaaatgctgttgaaaaggcaatctgcaggttgaatccgccggtgaacgcatcgacgtcaaccacctcgccgatcggataaagccctctgatcagcttggactccatgctcttgggattaatctcccgagcgctgattccacctgaagtgatcactgcctgctcgatcggcgcaaacgccttcggagtgaccggcagcgccttcaaaagcgccgcgaaagcgcggcgttcggcctgcgttatggaatgcacctttttctccggcgcaacgccggacaatcgaaccgccaccgggatcagcttgcgcggcaagagccggtcaagcgcattgataaaatcccggttcctgttctccgcgaaatcccgcaggagccgcgcgtcaagctgctgcatattgagcgccggctttagatcgatctctatgcgatacgcgccgggatcctccttaatataggaggaagccgacaacaccaatggtcccgaaacgccgaaatgtgtaaacagcatctcccccatttcggaaaatacagccttgcccgccgcattttttagcgtcagcgtcacatttttcagcgacaaccccatcaattcagcgcaccatttctcactcgcttcgatagggacgagcgcagcgcgcggcgatacgaccgtatggccgagacgctcggcaaggcggtatccatcgccggtcgagccggttcccggatagctcatgccgcccgtggccagtacaaccgcgtcggccatacatgttccgccattttccagccgcacgccgcgcacagcgccgtcctcggccagaatctgagaaacgcgtgcgcccatgcgtatacaatccttacccgcgaagcggatcagcgcgtcggcaatatccccggcccggtccgaaaccgggaatacccggtttccccgttccgttttcagcggcacgccaagcgattcaaacaggcgtatggtgtcctccggcgaaaaggcgctcgacgcactatataaaaagcggctgttcgtccggacatttttcagaaaaacatccggcgtacagttatttgtcacattacagcggccctttccggtgacaagcaccttgcgggccggccggggtcctcgttccagcacaagcgccggcatacccgcacgggccagaaagccagcgcagcacagccctgcggcgcccgcgccgattacgatggttttaattgccaccggctccctccccatgcttttcataaacgtcatattgatcccagatccgttcaaggcgttcataggtctgggcgatttcgccgcgctttttcaagccgaccgcgacaatcaacgcgttgatgagcgacagcggcgcgacgagcgaatcgataaaagaaaccatatcgctgcgcgctacgagcgtgtggtcggcgccttcggcaatcggcgactgcattgaatccgtcagagcaatcaccttcgcgccgttggtgcgcgcataatgacacgcctgtaccgtgcgccgcgaatagcgcggaaagctgatgccgataaacacatcgtccggaccgatccgcataatttgctcaaacatttcgcttcggcttgtcgtattgataaggcgtacattcgggaaaatatggttgaaataaaagctcataaactgcgcaagcgcggctgcggaacgcacgccaataatgtagatgctgcgtgccgcgcagatcgagtcaaccgcctgctcaaaatctgtacggctcgtctcctcaagcgtgcggcggatcttttcaatatccttaccgagcaccttggccagaacatccgcattctcgagctgatcgctcgtcacgtccatcctctgcacggtggtcagcttgttgcggatcaattcctgaagcgccctttgaagctccggataaccttcaaagcctatctcagaggcaaagcgcacaactgttgattcgctcacgccgacaaccgcgcccagctttgaggccgtcataaacgcagctttatcaaaatgattgacaatatatccggcaatcaaacgctggcccttggaaaaacccggcgtcatctgcctgatcactgtcaacagatcctgactcatgttgacatcccttcctatatcaaaagcccgcatggactccactgtccccgccaatggggcgcatctgcgtttcgtctgggctgggaccgctattgacttcttatcataacgtaatttgcaggaaaaatcaagcatcctgcgtaaatacgtctaaaaccatctgttccggcggacggtgactctatgccgcgccctgtcccattcagggcgtgtccccattgaatccgttctgctccctatttgcacagatgtatttgcgcagataagctgcaagcggctcacatgcacgctgcgcggtataaagcagcagcacgattacaataccgcctgccagacaaccgactctgttccataccgctgtggtggaatccaaaaggacaagcgatgccgtgatcgcggacaccgcattgatggtctgaacatgctgatatgcagacgtaaaactgccgcagtagccaagcagcagaatccccacagtggcatattgctgcggaatcagcagatcaaacagaattgtgaacaaagcgattccgacaactgtcgcacagacgcggtgccgtatgcgctggacagcgtcacaaaacgctggctgtgtcaacgacatgaccacaatggtaatccaaagcgattttttcaaatgcagcgcctcaccggccgctattgccaatgcgattcctatcgccatccgaagaataaacgcacgattgtttgaaatacataggtcgatctgcgcgcgaagcgtgcgcctctgcgaaatatttttcgctcgtttttgaaaaatgagcatcgccgctgcaatcagcgtgccgccggcaatcaggcccaaaatccgcagtataaaatcgcggcctgccacaggcgccgaccggcaaaacagaaagcaaagcaagaaattgatgtgtggtttcaacatcgccggttcagcaaataaaaccatcagcaaacatacaaatataaaatcaatcagcatcccagccaacaaacccggacgaggcagcgacgcgacgatcccgcatatcggatacaaggccaggatcaaaagcgcggcgcagccaggacggagccccaaatcacataccggaaacatcaacagccccacaaccagcgccacgccggccaggacattggtctgaccaaacaaagcagcaaagccaaggacaaatcccaggatcaatccaaagcgtatggtatttgttaatataattctgctgattctcttggttttttcggacaaagaaccttcccctccttatttaaacggaaaatatcatagcagttcaaatgcaggaaaacaagaacgtaacaattgtaaatattttatgaccttttattgtgttccgtttttttccgaaaaggcttgcctttttcattctgttttgctatactaatatagcattcgccggtgtgatggaattggcagacgtgctggactcaaaatccagtcctggcaacagggtgcgggttcgacccccgccaccggcaccatacaaaagatctggagctagttgtcgttccagatcttttgtttttctaaagtttccgcccgcatgttttgacatcttaagcgcccgggttttctgcaatatgcaatataagtcccatgcttttttaccgggcaataaaaaagcatcccgtgcgatagaagcggtttcccataaaagccctaaagcccggcggactgaatccgattcctgcttttcaggaaggtttcaggccgccgggctttttgttattgatattgtttaaagagcaaacggacctcctgttcgtcaagggtatttccctttttgcaagccgccaattttatttggccgagcagatcgcttttttgttctttatccaatttgatatgcagccggtccgcccagcaatcgatagagggaccgccgctgtgctttccgagcaccacctctgttccgggatggcctgtcaattcaggcaaatacggagtaaccaacagcggattcgtatttttgacatttttgtaccagcccgctacaatgccagattcaatatcgaatacacggtcgccgatcacgcccatattgccgcgaaccggaagatcgataaagctgcgcaacaatttggaaaggctgtaaattttgctgtaatcaagtcccaggtcatagccgtacatcgtcaaaagcgcgagcgccaaatgctcatatgccgcattgcctgcacgctcaccgcaggcggaaatcgtagtatgcaccacatccgcacctgcggcaagccccatgatgctgttggccacaccaaggccaaaatcatcgtgaaaatgcacctcgagcggcttgtcaatccggctcttgatggcgtcaatcagatatgggaccgtatgcggagccagcccgcccatcgtgtccacgactgcaagcgcgtccatatgtccatctgcggcaacctgcccaatcagcttgagcacccagtcaatattggcacgtgtcatatcaattgggaaaaacaccgtgtacagcccggctccctgagctgcttttgtcgccttgaccgacagctcaaccgccttttccaagctccagccgtatgcttcccggatcatttcctcgtttgatggaatctcgattacaataccagataccccgcagtccgccgcacgcttcacatcatcgaccatacagcgcgcaaaaccaaatatctccgtaggcagcctgcgcttgacaatctcgctgaccgctctggcatcctcggctgaaacagcaggcattcccgcttcaattctatgtatgcccaactccgccatcttttcggcaagcgcgattttctgatcgcacgtgagtaccaggccagcctgctgttcaccatcgcgcagcgttacatcgtgtatcttgattccatctttaaaatgaatccctctgcgcacctcctccgcaaagttccaattgcttgtaaaccatttatccgtgtgccactcgttcatattaacctccaccacccaaatatgggatgtctttcatgaagccttatcaggcttctgcgcgccgcagatcagcggcaaaagatatacaggcttgtaagccgcatcagataaaacggcaaattcgatcgatcgcagtatctgaaaagccgtaagtttccgccttggtcagcttaccttctataatctccatcatctcgtgatagatgatttcgccggcttgctcaatactgatctcgcccgcagtaagcgcgctcacatccacctcgatgttatctttcatccgttcaaaggtggcgcggttgcctgtaatcttgaaaatcggcgcgatcgcatggccggtcggcgtaccgcgcccggttgtaaatgcgatcatctggcagccgcctgcgatcatcgcggtgttacaggcgatatcatatccaggcgtatccataataatcgcaccttttttagttggacgccggccttccgctacaacttcgacgatgggggatgttcctcccttattgatacagccgagcgacttttcctccagggtggacagtccgccctctttattgcctggcgtcggctgtccgtggcggcagtcctgtcccattgcatgaaggtaatcctcgaaatccttgcagattgtaatgatctgatcatggatctccctggttgcgccgcgccgggccaacacatgctccgcgccgatcagctcgatcgtctccgccataacagtggacgcccccatcgcaatcagcttgtcgctgacataccccagcgcgggattggccgcaaagccggaggtcgcatcagaaccgccgcactccaatccaaggatcaaattggacataccgcacggttcacgcttctgtatggaagccgccgcaaccatttcccgcgcggcacgaaccgccaatcgaatcgtattgggggtgccgccctcctcctggataccgaatgagacgattggcttgttggttattttttcgatagcctcccgcagttccctgtggccgacattttcgcagccaaggccgatcaccaccgtgccaaagatgttcggattggccgcaaatccgcgcaggatggtctgggtcatatcctcattcgccttgacctccgcgcatccgctgttattgatgatatgtatgctgccggctacctgctgtgaaacgacccggcaggtttcactcgcacaggcgcaggtcggcaaaatcaatacgtgattgcggattccaaccagtccgtccgggcgtttatatcccataaaagtcatgctcaaccctcccttttttcatccagttcgctgttgtaatccctttgcaggctctcgatattcaaatgtgaaacccactcgcccacaccgatcgggcgggttgccgctccaatgctctccccgtatttcagcacatggccgccgggttcgatcggtgcgatcgccgccttatgacagggtggaattgtctcccgcgcaatgagagattcaagctctccatttgcaaaataccggatctcctcgccttgctttgctccatccacaacggttacgacattgtcctttgtactcaataaaatcgcattcgctttcatctgctacctcctgtactccagtttgttcaatgagtctgctgtttatggcgagcgtcacgccttcgacgcccttttcgcctcccattcgacagccgtaccccattttttcgcagccagcgtggtcacaatcggcaccagaataattgtgacaatcacagccgccgcgcactgggctgtcgcactttcgaccacctccggtgaaaactgggtggttgccagggcaaccatagccggagtcgctacacagttgcccgctgcgcttgaaatcgcagcgcccgcgtaacccggacggcgcaggatgaatttatcggccaggatgcagataaatgccgaccatacgacacagatcaagcccagcagaatacctgggaagcccgccttgaccagattgctgaggctgatgcccgcgccgaggcagaacgcgaaaaatggaatcagaattgccagcgccggcttgcagaagtcagagatatccttatcaagatttccaaggatgcatccaatcagaatcggcgcgatcgctgcgatcaaatttgtaaacgggatatctgccatacccgatgcacccagggcaacaagcgtgagaaacggtccgtcgttaatattaagaatggcctgcgcgccaatatcgatatcgtcgccgaattggcttgccagagacataaacaatccgccgtttgaattggtaactgccgagatcaacgccagcgaggacaagccgagaatccccgcctcaccgaagaacgcgccgaccgcccatccgattgacgcgcccgccaggaacttcgccgccaaaagcacaaagccgcgtttgagcacctgcggagcctgttttacacgaatctggctgcccacacaaaccaaaaagattcccattgcagtatttgcccccgcgctggaaaaggtggcggttgtcaagccgccaatttgcagcagaccgggtgcaaccgtattgaaaaggacgccaagcagcagcgggattaccatcgttccaccgggaaccttctgtacggtttttaaaattttcatcgtaaaacctcctcgaattgcggctagctaaatagcctggatcgatttcctcaattctcctgttttggcttatttatccctttttcttgaaaattgttttgtattaacgaacatcgttcgtaaaatttgggaaatttaaaagaaaaccgaagttttcttttaagtaaatacaaatgtttactgtatcccttctttgtatcccatccggtaagaaatcaatcgggaacaacgtacaatctccggcgcaatctccttcattcgcatatcccccatccgatagatcggaccacagatgctgaccgccccgatcaccgattttgagaaatcaaaaataggggcgccgatgcagcgcaaatccatctcgatctcctggtcgtcggttgcatagccctgctcacgcacctgcttcagatcgcgcagcaatgcttccggctcggtgatcgtgtatttggtcagcgcctttagcggctggttgagcacatattgctgaaggtatgaacccggcagaaaggccagcatcgcttttccaacgctgctgcaatgcataggagcgcggcgtcctgtctgcgtataaaggatggtgacatccggaacacggtaggattctatgtagaccacttctccctggtcatgcgccgctaaatggacagtctcatggaacttgcccagcacctccatgacaatgggcgaggcttcccgccgcagatccatcctctgctgtgtataccggccaagctcaaagttgcggattcccagcctgtattttttgcttataggcgactgctccagaaaattgcggcaaaccagcgaatttaccagcgcgtacacggtgctttttcccaacccgatcatccgggaaatttcggagatgccaagctcctcattgtcttgaaaatagcagagaatatcgagcgcgcgcaatactgactgcaccactgtcccattttcacctttcatagccgaacccctgtcccttccaatacatgtgcaaactgattcaggcaaagcatactatttctgtcccgctttgtcaaggaaggctgtttgtgtggctatgcctttataaaagcctgctattccacccggtttttcaagcttccaagcccttccacacagcattccaccagatcacccggctgtaaaaagcgcggcggagtatatcccatgccgactcccgcgggcgtgccggtcagaatgatgctgcctgcctttagggtaaacccatgggaaagctcactgataatatgtggtatctgaaagatcatctgactggtatttccatcctgtctggcttcgccattaacccacgactgaatcctcaaggccggaatgcccggaatctcgtccgcagtcaccagccagggacctagtacagcaaatccattgaggctcttgccgaaatacggatgtgcataacggtattggatatcacgcgcacttacatcgtttgcggccatatagccaaatacataatccaaggcgtcagcctcggatacattgtccgcatcctttccaatcaccacggcaagctctgcctcataatccaagcgttcagtaaatcctgcgtgtgagcaaatcgaatctccatctgtcaccgcacggtttacacgcttgccaaaataggctgcatgcgggcgctccccatcaaaggccgtgttctggtaacgaaaggattccttcgcgtggtccatgtaattttcacccaggcagatcagatcctgctttggaatcggaatcggcgcgcaaagctttaccgccccactggaaaacttttctgcacagccattcgccacacccgcagcaaggcggccgcgttcggtgtcggttatacaatcgaccagttcattcatatcccgatagtttaaacccaaagccgagataggatagtaataccgcccatcctctgaacgtacgccaaccaactccttaccttctgccagaaaggtcactaatttcatccagcccctcctttgttcgtaataaacgaacgtcgttcttatttttaccgaaaaataaatgcggctaccgcggatttcgatatttatttttgcaaatacagtaggtgaattgcaagtgaaattgcgaaaaaagtagtggaaatttaaaagtttgttcattcttaacaaaagcagtctccataaaataggaaaaaggttgaagggcatagcttgcccctcaaccttttttgatgatgttctgagactatagaaacgtaatggtattattccgtcaaagatgcatcataatcacccgatcgtgtgggcgcgtcagattcaaccccggacacaatatccggacaattttccgggtcgaacgggtcgtgaaactcaataccggatgccatatcaaaccattcgaaagggtcgtgaaattcatatggtgtcccgtcagcgttcacaaccatattgtaatcatcgtccggaatttcagtcgtttcaatcaaatgcctgaccaacggtacaacaaaaacagcacacaccagaagaaagatcaaagcaagaacaaaatcgacaatcatctttgtctttggcatgtcccataacgccctgcgaaacagtagacggataatcacaaagataagcccagcaatcacaaatggaaggacaaccttcaaaaaattaggccagaatactttgttaattacttcgtctaaattgagccttggcatatctggcataccgtcacacatcctcaaacagtcataaggttctcaggtgggggagaaaaaggtcgtcagaacatttgtaatcaagaatcttgcgggggtagcggttcatccaatcctgaatgcgttggatgtcctgttcgctgtagttatccagccctccggctgtatcggttgagcaaaagtcagcgtgggaatggtgtggtatctttatctaagtgaaccccctgaaagccaccctgaaccgggaacagcggaagctcctcttggccctggtgaacgcccagtctctgtggcaggagcgcacctctctggagagcttcgctgccggccttcggctggggctgggtatcgcgggagaactggaaccctactccttcgacgatgaccaggaggcgcgggccaggcggaagatggaagcagaaagcgactgacgaaccaagtcccagggcggcacggtcgaggaagggagtgttccccccttcaggaattgcggcgcataaacaattaaaacccttgcccccagaaaagggcttggcgcacggccgggattgggatgccgttgacaacgaatacaatgccgaaccaacccgcccaaatgataactttctttgaactctgggccgtgcccctggctatttcctgtttctgtggtattgtgtgttgctgataaggagggatgaaccatgacgaccaatcagcccccgatccggcgatgccagtactgcgggagcgacgatcttggcctgggctggcagcacggcgaggccatcgtcaccttcaaaaagcacggactcctgggcaaccggctccgctatctgatctgccgccgctgtggagcggtggtgtatcaatgggtggcggagccccataggttcccgcctatcaagtgagtcacccagaaattgcgccgcaaatcaaagataaactctggaggtgagcagcatggcaaagcgcaggccgtccggcgacggcatggtcagaaaaagagaggatggccgctgggagggccgcatcgtggtgggccacaaggccaacggcgactccatcttccggtacatttacgccgacacgcaaaaggaattgaccgccaaactccgccagtacatcgatatttaccgaggcgttgacctgacggagcagagcaggatgacccttggggagtggctggatcagtggctggaggacatcgccggaaccatccgtcctaacaccatgacacgttaccagggtacggtcgcccggcatatcaagccctatctgggagacaagcctgtcgcccaggtcaaggggaaggatatccagaaactgtatgaaacgctggccacacatgggaatcgaaacactggcaaggaattgtccagcggcacgatccggggcatccactccatgcttcacgaggccttggaagcagctcggcaggcgggcgtcattcctaaaaatccgacggaggtgatcgaggccccgaagttcagctacaagtctaagaaggtactgaccgatgagcaactggagaaatttatggaggtcatccaggaggatgccgtctggtacgacttcttctacacggagctgaccaccggcctgcgccggggtgagatctgcggcctccagtggacagacttcgatgaggttgatggtaccctcaagatccgccgtaccatccatgaggagcgcggcggcaagctgacgccctgggacaccaagaccgctgccgggacccgcaccattattctgccgcccagcacagcggagcttctccgggagcggaaaagatccgccctgaccgagtggatcttcccgaacccgctgaaaccggaacagcctatccgcccaagttctggctatgagagaatgaaagtcctgctgaaacacgcgggcctgcctgacattagattccacgatttacggcatactttcgccacccacgctctggccagcggagtggatgtcaaaactctatcaggtatcctggggcatacccgagccgcgttcaccctggacacctatacccataccaccggcgatatgcagaaacacgcggcagagatcgtggcaaaattcctgacagacatctttggagaggagttgaaaccgtgggaagaaagcgcaagagcggtgagggaaccgtccgtctgagaaaggacggccgctgggaagggcgtatcgtcatcggctatgacgagaagggcctgcccaagacgaagaatgtcctggccaagaccaagggcgagtgcgtggagaaattgaaagccctgaaggaaaccattacaccgcccacacccgcgaaaatcaaggcggatatgcccttcggggaatgggtggaatattggtatgagacatacagtaaaccaacatcccgccccagtacacagcggaactatgagacatatatccgaaaatatatcaagccgaggttgggaaacattcctctgagcaaggtgagtacgaaggatgtccagcaactctgtacatggatgaaaacagaggccagagtggatcggagcgacgggaaaaccggagtggccgatcggcagatactcaactgctacagcctgtgcagcagagcactggacagagcggtgaaagaaaacctgatcgcgcaaaacccggccatcggttgcaaattgtcgccgatcaagcaggaggagatgaagatcctctccagggaggccatgcagaaggtgctgatccaggccaaagaggaaaactactacgaattattcctcctggaatttgcaacaggccttcgcttgggagaactgaccgctttacaatgggatgacctggatctgaacaccggagaactgcggatcaggagacaggcggttaccgtggactcggatgtcatcattaccgagccgaaaacgaaggccgcaaaccgcaccctgatcctcccaccgcaagtcgtaacagtgctcagagagtacaaaaccaaggtggattccagatgggtgtttccctcacccaaaaaggaggatacccatctgcgcccctctgtgatccaccatcggctacacagtatactggatcacgccgggtgcgagaggatcaggttccacgatttgcgccataccttcgccaccaacgccctggcctatggaatggatattaagacgctgtccaccatcctgggccatgtgtcctgcgccaccacgctgaatacctactcccatatcactgacgagatgcggcagaaagcggcggtgaagatcgaccagggcatcgccaaggcggaggttacagagcaggaagaaaagccgaaagagcgaacaatgaccaccttccaggcaaggaaacggtggagccgaaaggcaagctgagactaaaaatatttgtgcatcagggaaagcatttattaggggactgaaaaatcggaaaaccgtcttgacttttttcaataaaaaacctataataatgtcaaaataacaaaggaggtgctttatgcgcaccaacaatatttgctttccctctgaggtacgagccaaaatagtcaaatgtgttgaagatgcagtaaaggatgatatccttgcggatattcaacatcacagtctgcggacaactaatagcgttcccacacgaatttgggatttattgaacacaaatcttgctcgggaacttgaaactgaggattgcaccattgcggatgcgcatcgaggcccttggcaaatgcttgttgtgtttgataaaacaactcaatgtattctcacgtttatgcgtgaaaaaagatttgctgaacttcgtagatttcaacggcgtcggagtcatatgcattatctggatatgttgacaagacagtttaacaaaaggttattagcggatcagcagcagatagaattatatcctcacactttttctgatgaggataggcttcctcaattaatccaaactctgttgcacgatttggaagacgagatacctgttgtacagaatcatgttttggttttgtttgaaacgaccggttaccagttatcacatattcgagcagtcaaagtgacacccaaccttgatattgcgcaagatggttctcaagattggtcggagtatatttcgactaatgttagtgttgtagttgagaaagttgctcattccgatgctcctgggaatcagcccaatagaggtcttaaacttaagtcaaaagctattgcaagaaagaaaaatgggcttcagaggaaagaaactcaagaaattgagacgcaaggttaatttaatgaataggagcgttgcccaatatgaaatctcagtttaatggagaacgcttaaaaaaagcgagaatatataggggcttgaaggttgctgaactggcagaacgagtgggttgtcaacggcaaacgctatctatgtacgaaatttgtaaaagtcaacctgctgattcgaaaattgtggaacttatctctcgtgaattggattttcccgtcgactttttttacgagcatccggaacccataccagcaagcactatatatttcaggtcgttgcttaccaccagcaagaaatatcgcactgaacaggttgttaagatggagtttctggcgcagatatattcattgcttcaagattacatcgaatttccgcggtatgaacctctatgcttagttgaagagacaactccagaggaggcagccactgcgctcagaaatgcatggaatcttggctatggcccggtagaaaatttgattgcggttgtggaacagcacggtattttggtaacatcattttctacaagtaccgacgatgttgacgcatttagccaatttatagatattggagataacccaacctatttaattgcatactctaataacaaaacctctgcgtcaagaattcattttgacatcgctcatgagctcggtcatatctgccttcatgaatggagcgatgagatcgaaagctatactaaggaagagtttaaacagagagaacagcaagcaaacgattttgctgcagcatttttgttgcctgaaatatcctttaaacaagatgcgctccgtgccccttctggctccaaagcccttgtgtactacaaacaattgaagaaaaaatggcgagtctccatcgcggccatgattcgtagagcaagggatttaggtgttatgacaatggatgagtatcaaactctaatcaaaataatgcagagacgtggccaacgcaaagaagaacctttagatgatgtgttaattacggcaagtccttcactgttaaaaacatcaataatcatgcttttgcaagagggtgtctttagtcgtagagagtttatggaggagttatcgtccaattacaatttaagcataaaaccggaagaaattgaatacttgctcgatttacctgtcggtacattgataccacccaaagtggtagcgttttcttccttgcagctcaagcaacaagggaaataaaggatactgccaaagtagatgcgacagaagatattacctgcacctgaacgtagtatgccatgattaccttcaaccccagaacgtgctgaaaccaaaaggccggctgggacaaaactaccggcccatcaggaattcaatccccagtgggccggttttcgctgtctgtgggcaaacatgtggtcaagaggagaccagccaaaatcaagaaatgaaaaatgtgccataaaagcaactgtttccgggataataggcgattttcaagtgagaaaatcagaaggttaatgcgtatcccttatcgcgctggcacatacaaagaataaggcacttttttacaaggagcgtggaaaggtatctcattttaccatgccgccgcgcaaaagacaacaaaggcatacacagggcgataaagtagtggctatttccctctttctgtggtattgttcggttgccgaagggaggcgacaatatgcagaaagaaaacaattacacggtgggccagtggtgcgaccgctggttctgcgagaaccagggcagatggagcggcagcaccgtgggcggataccacaacctgatctaccgccacatcctccccggaatcgggggtatcccgctggcggaactgaccgaaggcaccgtcaccagcttctatgacagcctgcggagccaggggctcagcgccagaagcgtctggtgcgtccacctgctcctgcggcgctgtatagacgaggcagcccgcgaccagcgcagcccttacaacccggtgcggctctgtcaggagccacaggcagaagcgtatcaaacaactcctttgcgcctggggcagctccagcggtacctgaacgcggcggaacaactgggtgcgctccctctcatctacacaggattatccagcggcctgcggcaatgtgaactcatcaccttgtcgtgggccgattttcatatccgctgccggtacatcctcaaaggacagcgcctgctgaccctcaacagcaaagcggaacatcttctggaacggatgccggaaatcggcttctatgtgttcctcaaccccaagaccggatcgccgtatcagctccacgagttctattacctccacaagcggattctgaaacaggcgggcctgccgtgggtggccttccggaatctgcagcgccagtgcagggaggtggggatatgacgctgagagagtacatccttcactggcaggaggtctgcgacaaaaaccagagcaggccgactacctacgcggcccatggttacctcttcaagaaccatatcctccccggcctgggggagatcccgctctctgaattgacggtgaagcaggtgggagatttcctggaggagcgacggcgctttggcggtcaccgaccggaaagccctgagtacccagggctgggggagcataccatgcggcacatccaccgcctgctccagcaatgcctggaccaggccatccgggatggcttgatagcggacaaccccgcccgagcctttcactacccaaagcccaagaaggtcagcgccaatgtactgacaccctcagaagtggaggactatctggacgcggcggagcggctgggtcacctccccatgttcctgttggcgctgacggcagggcttcggcagggggagctgatcgccctgaagtggagcgacctggatgtaaaagggcggacgctgaccatcaccgagaaacgctcggtggaacggcgggagccggtggagtacgagggcggcaccaggatcgtcaacctgcccccggaagcggttgaactcctgcgcctggaacacgccaaacacccgggaagtcccctcatgttcatgcatccggccacgcagaggccctactcaccccagatggtgcgccggctgcacaatgagattatccaagaggccgggctggaccacattcggttcgcagatctccggcacacctgcgccgtcctgtccctgcaaaacggaatggacacgaaagaggtttctcaaatgctgggccatttcagaaccgtaatgacccggcagaactatgccccctatctggccagcccgactgccaaggacgagaacaaacccgccgaagcgtctcgggaggaactgcggcaggcggcagatattctggatcacctcctgaaattctgatggatattctccggaaggtgtggtatatgtttgtgtcacaaggaggcgatgacaatggaaaacgaactgctcaaggggctatatgactgcttctataccccaccggagcttttcgaacaggagaacgaagtggaggagtgccacaaagcgttgattgcggctctggaaaaaccggagcgaaaactggtgctgcggattatcgacgcccaagactatatcacagaacagacctccctcgacagttttatcgccgggtttgaactggcgtggaggctctcgatggaactatacaacgatgaaaacgagcgctcattctcctgtcgaaccaggagaacgggcgctcgttgtgtatgagaagaggaaatataaaatcagcctgggcagcccgcgaaaagctgcccaggcattctgcttgtaggcttggttcagcgttcccacagaaggaccgcatccgccactgcctgctcaaattcggactgcgtcagaccggggagctgcagataatctcccaccaaatagcagaccgcatccacctgccgatccacctgataggtggctgtctcaaagtcggtcagcagcccgttgccaatgcacaaatgtccctcacggttcggcatcacatcagagcgaagggtacggtcaaaatagaggaaaacaacattccggccgtctacctcccggctgaagccgtggaaagaatcgtagctcccgccgtgatagtagaggtcaattacctcatccaccgcaagctctgccgttaccagaccgtctgtataggataccggctgcgggacatcagctgcccccaccaaaacaatggagaagatcagcatgaccgccacggcaagcaggaccgcccgccggcgcccacgggaaaacttcttcttcacgccctgaagaatgcgggcttccgtttccgactcatgggagagcgaggggacaggagcatcctccttcatttccgccaaacaggtgcggcactcctcgcattgtgccacatgggcttcgatctcctgcttgctggcctcgctgcacagcccgtcgcagtacaggggcagcaggtcgcggatgatctcacatttcatcataatccctccttgattttctgtttcgcacggtaataagtcactctggcccagttttcagatttgtcaaacaattcaccgatctgcgtatagggcagttccgcaaagacccgcagggtaaacacctcccggtatggctccggcagagcatggagccgctggtggatctggcgggcgttttcctggatgagcagatcctcttctacattctgaggagaggtcatctgctccagggcctcatctcccgcctgccgtttcgcctttctcaagtaggagagccagcagttcttcccgatttggcacagccatacggacagccggcatttcccttgaaaggaggcgctgtgttcaatggcacgacagaaggtctcctgggtcaattcttctgccaacgcttggttcccacagagtcctgtcagatagcggtacaccactgggaactgctccttatacagctggtcaaaatccatccacaccacctcgctttctgcctatatgacgcacatcaatgcgggttgttacagaatttttatgaattgaccccaagcacaaggtatctccaaaagttatttggtagctgtgtttgatttgaaataagtgtctgaaaatgaaagcaaaaatctgaaaaatggattttcaatagacaaagcgctcttcctttgctaaaattattccatataagtataaacccagcgcatgaggtgttattatgaccgtttgctacaataaactgtggaaactcttgatcgataagaatatgaaaaagaaggatctgcgcctggttacaggtatttctaccactgctcttgccaaactgggcaagaatgagcatgtcagcacggagatcctcactaaaatctgcaaagcactggactgtgatttctgcgatattattgagttggtgaaagaggaaaatgaggattgactttattgagatagagctgcagcaggaaaacaaccgcatcgaagccggccctcggcggtcttccaaatatctttcgtgctggtgtgaccagggctgagtgatgcctgcagttgccgaacagcttgagttggagagaacagttttattgctcactttctcaaaagtgagcaataaaagcaagtagccccgccatttatagtgaatgagagcgattggttagccaatacctggcctgtgagatttgcacagatgacaaggatatcgctggcctacttggaattcggattttatagaaaaataataaccattaggttactttcggaggatcagtatgggaaaagaactattcaagaatatcccaagcaaggtgggagacttggttaaagatgtgcgtaatggacgtattggcctgcctgatcttcagcgtccatttgtctggaaagacaataaagttcgtgaattatttgactctatgctcaaaggttatcctattggctacattatgctgtgggaatctccctctgattacgaaagtaaaaagagcgccatcggacaaaatgcaaaaacatatgaagaacccaaagaacttgtgattgacggccaacagcgtctcacagctctcgtggcggcaatgtttgcagtaaaggtaaaagataaaaactttgctgatcgtgagattaaaatttcttacaatccattgactcgtgaatttgctgtgtggtctcaagcatatgaacgggacccggaatggatcagccgtattagtgatgtgtttcttgcgaaagaagataattccatcagttctctccggcgccgtttcatcaaagaggccaatgatggacgcagtaaaaaggaacttccgctgctaaccgatgaggaagaagatagaatcgaagataatatcaacgcacttctcaatctctctgattattctttgcctaccctggaaatcagctatactgcggatgaagaagatgtagcagacatttttgtccgagtcaattccggtggccagagcctgacagaaaataattttatccaaacccttatttccgtttatgagaatgaaaccagtgataaaatcaatgcctttgcagcagcatccagagtaccggccgccaatacatcctacaacactcttttggcggtcgagccatcccacctgattcgtatggcagtcggtgtaggctttaagcgggctcgcctgagatatgcttatatgcttttgagaggtaaaaacctggaaaccggaaagttttctgatgaggttcggtatgagaatctccagattttcaaagatgctctggataaggtcatgaatctaaacaactggcatggatttatcaatatcgtggccgaggccggatatatcagcgataagctgattgcatcttccaatgcggttgttttcagttatgttctctacctgattgcaaagtatgattataagctggacgctgcgcagttgaagaaatgtatcagcaagtggttctttatgagtaccattacttacttctataccggctccaccgagtctgaagtagaaaagcaatttgcagatttgcgtgatattcataccgcggctgagtttgttgcctacctcgaccgagtcatcgaaacccactttaccgatgactacttcaggctgacccttcccaacgaactgaacagtgctgcagccatttctcccgcatggtatggatatgtggcggcgcagattgtgctgaatacccccatgctatttagcaataccccagtatcaaagtattttattcttggttccagcggaacgaaaaacgcaatcgacaaacaccacattttccccaaaaactatctgaccggtattgggttcagtagtgaccgtgacagaaatcagattgccaacttcacttatcttgactacgccacgaacatcgaaatttctgataaggctcccaaagattatgttgcgtattatcgccagaaactcggagaagaagcataccagaaagcctgtgaagaccatgcgttgcccactgactttgagaacatggaatatatggagtttttgagtcagcgccgagttctcatggcacagacggttcgcaaagcgtatgattgcctttgtaaattataaatgatagaggagcatgattatggataatcaaatccacaaccagatcgttaattttatatggagtattgccgatgattgcctgcgcgatgtatatgtgcgtggcaagtatcgtgatgtgattttgccgatgacggtaattcgccgtctggatgctgttttgcaggatacgaaacagcaggttatggacatgaaagccaaactggatgccgctggtattaccaatcagacagatgcgctgtgcgtagccgctggacaggctttttgcaatacttctcctttccgtctgcgtgatttaacggctcgcgccaagcaacagcagctcaaagctgattttatcgcctatctggacggtttttctcccaatgtacaggagattttgcaaaagttccagttccgcaatcagatcgatacaatgatcgaagccgacattctgggcgcagttattgaaaaatttgtgtccaaggaaataaacctcagccctaatccggtttataccgatgatagtaaaaccgagatcaagttgccggggcttgataaccacgccatgggcactatctttgaagaactgattcgcaagttcaacgaggccaacaacgaagaagccggcgaacactacacgcctcgtgatgtggtggaactgatggcagacttgatttttgtacccatcaaggaccagatcaaggatgccacctattcctgctatgatggagcctgcggtacgggcggtatgctgactgtggcgcaggatcgcctgctggaactggcggaagaaaccggaaagcaggtttcgattcacttgtttggtcaggaagtgcagccggagacctatgccatctgtaaagcggatatgctgctgaagggtgacggaaagcaggcagagcatatcagttatggttctacgctgtcgatggacggtaacgctgccagacagtttgattttatgctgtccaatcccccttacggaaagacctggaaagtggacgcagaaaagatgggcggcaaaaaagacattctggacagccgtttcaatgcctacctggaggatggcactcagcttgccatgatcccccgtgtcagcgatggccagttgctgttcctgctgaataatgcggctaagatgaagacggatactcctctgggcagccgtatcgctgaagttcacaacgggtcttcgctgttcactggtgatgcaggttctggcgaaagcaatgcacgccgttatctcatcgagagcgatctggtggaagcggtaatcgcattgccggagaaaatgttttataacacaggcatcggtacttatatctgggtactgagcaacaaaaaagaagaacgccgcaaagggaagattcagctgatcgacgccaccacgatgaaatccacgctgcgtaaaaatatgggcgagaaaaactgcgagctgacaccggagctccgggatgaaatcatgcggattttcatggagatggaagaaagctccgtcagccgtgtatttgacaaccgggaattcgcatattggtccattactgtcgagcgccctcttcgcctgcgggtgtaccctgacagaacgattcctgccgacactttcaaaaaggcggaggagttggagcaagtacagaaggcaatccgctctgtcccggcaggaacccctaccgatgattggacggtttttgccgaggccacaaagctaaaagcggccgcattgaaaaagattcgtccctttatcacggagaaagaccccatggcgcagcccattgacggagaacctgataccgacctgcgggacacagagatcattccctttacttatgagggcgggatcgatgcctttatgaaaaacgaggtgctgccatatgcaccggatgcctgggtagacgaaaagaaaacccaaatcggctatgagctgtccttcaccaagtatttctatcagccggtacagctgcgcagcatggaggaaatagtggccgacctcaagaagctggaatctgaaaccgatggcatattggcggagattcttggaggggttgagcaatgagcaagtatgaaagctataagcccattgaagaactttggctaactcaaattccagattcatgggaagatattaagataaaattccttttttccgagcggtctgaaaaaggatatccagatgagccgcttttagttgcatcgcagaatatgggggttgttcctaaaggtgtgtatggcaacaggactgtacaagccactaaagatctgcatttgttaaaattggtcagagtaggagacttcgttattagtttgcgctcttttcagggcgggatagagtacgcctattatcaaggaatcataagtccagcatataccattatggttcccaaacagaaaattgtaccagggtattttagatatcttgcaaaatcgcggttgtttatagagttattgcagctctgtgttaccggaataagagaaggacagaatattgactatggcaagctaaaaaaccatcttattccagtaccacccagcgaggagcaagatcagattgtacgctatctggattggcagacttccaaagtcaaccggctaatcaatgcaaaaaaacgcatcatttccttactggaagaacagcagcaggctacgattgcttatgtagttactcgtggattagatcagaacgcagaactgatggatagcggaattgactacattggtaaggtccctgcccattggaaagttcttctgaatcaccggatttacaaagaaaaatccagaaaattcggtgaggaggaaaccgtgctttccttatcccagaaagatggtcttttgccatatgagaacatgaaggagcgatccttgcatactgcgtcctatgaaaattggaaattggtgtttcccaatgatctggtgctgaatcgcttcaaggcccatttgggggtgtttttcagttctaactatcgtgggattgttacattccactatggcgtgtatgagccggtcatgaaaatttcgtctaagtattacgaggcgctctatcatacacctgagtttagacgagtgttcgcaagcaaatcgaacggcatgaccgtagggttgcaaaacctctctaacaccaatttttatagtgtatacacggtatatccgccgcatgaagaacaatgccagattgtttgcaaaattaaggagattgaggaaaaatatcgagatcttattgcaaaaatcaatcaggaaatagattgtttgcacgaatataggactcgccttatctccgatgttgtgacaggtcagattgatgtgcggaatattgaagtaccagattttgagatggtcgaagaagcggcagatgaagccgaagaaccagaggacgagatggaggtggaataatgagcacagaaactaaaaaggtatttatctcgtattcttggaaagttcaagaaaaagtaatagaactggccgaaagattgatttctaacggaattgatgtcatccttgatgtgtacgacttaaaagaaggtcaggacaagtatgcatttatggagcaatctgtaaatgatccaagcgtagataaagtattgatcatttgtgaccgtagctatatggaaaaagcgaatgatcgtagcggtggcgttggagatgaaacggtcattatttcaccagaaatatatggccagatgaagcaggaaaaatttattcctattgcttttgaagtagataaagaaggtaaagcatgtattcctcactacttaaagactcggatttatattgatttgacaactgaagatgatcggtatgaaactgaatatgaaaaattgcttagaaacatctatcagaaaccaatacacaagaaaccagctttgggcacaaagccggagtggttagaagatgaaactgtagatttatctgctattcgcgatattctgaaacaggttcgaggatatacgggcggaaatacagcaaaggcggatttcctcttgaggaaagcttcagatgaatttgtggatgccgcaaagcagtatgtactgcctaaggacatagacattgcagatgggttattaaaagcaatcgatcaaaccaaaccatttagagatttgtttgtgacctattgtgagaacttgatatacagtgatcagcttaaaggtgaaattttatcagaactatttgagcgtttgtataacgaactgcatgatgctggtggaaaaggggcctatagcgagagcgacttcgaattatatgattatatgatttgggagttttttatttgtgccacagctgttttacttcactatgaacgatttgctgaattgagacaactgctggttcacccgtattttttgagaactgattactttaattcaaatattgaaccgcaaacttttgatatctttcggaaatataccagaaccatcgaagaagtatgcaagcctaaaagtgaaaattcacgtttatttactttagcgggagagatacttgtaaatcgagaaaagaaaccgattctgacaaaacagtcaatcgccaatgcagatattgtactctaccagctaaatgatatttttgatacctctgagaatgagcggtggagtatgtggttccccacgacatacatttatcatcaaggtcagcaggtcctatggaaaaaactaatttctaagtcatattgcaaaaaaatattccctttgttttcggtaaatacggtagatgaattgaaagaaaaagtgcaaggctctatagggaatcgagatatcaggtataatggttcttggcataatgctccaggaattttgtcctcaattaagcttgatgaaattggaacgctggaatgaggtgacactatgccaaccaatacaaaagaatctggccttgaaactttaatcgtggattggctggtcaaccataacagctatgagcagggcacaaatgccgtaaaaccgcgactatgccattgatgaaactcgcttgttccgctttttcagtctacacagggcggtgcaatggacaagttgggtgtgttataggaatacacacttggctggaagaaatcaggtggataattttgatagagataaaagaatgggattggcaacctgttaagaaaaaggattctattgaaaaaacggtgacatgtccttactgcaatgtacgagtgcgagcaatttctaacacaagaatttttgatgttgcgacgggagccattaaataccatatacataaatgccctgaatgctttatgccaattatcatcggtttagatgggaaaattattccacaatctcaatttttgccgttcgatgaagtgcgctacttgcctcccactatagaaagactctataatgagtgcaggaaatgtcatttaaacgaatgctatcattctgtcataatggtatcaagatcgttattaatgcatatagcagtggacaaaggggattctgcaggaaagtcttttgctgcatatatagattacctggaagcaaacggttatattggggttcagaataaggcatgggttgacaaaatacgaacaataggaaacaagtatgttcaccaattagatgaagcgacagaagaagatgcgagaaaggttattctatttctgaagcagttattggggaacctatatgaaatgccacaattagcaatctaaggggttttcttatgagtacaaacatcaaagaaaatggatttgaacaaatgattgtagaccatctatgcagctgttgtggttatgaagaaggaaaaaatgcagactataacaaagagtatgcaatagatgaagtgcggctttttcgtttccttgaaaccacacagcctgattcgatggaaaagttgggaatacgaaaaagtcatcaaaaatatacccagtttctcaatcgcctgcaaggtgaaattgccaagcgcggcatcattgatgttttgcgcaaggggatcaaggtttacccggtagatttggtcatgttctacctgaccccaaccgccaaaaatatggctgcccgtaagatgttcgagcagaatatctttagtgtaacccgccagctgatgtattccaaggatgccacaagactggcgctggatctgtgcgtgttcatcaatggtcttccggtcattacattcgaactgaaaaaccagctcaccaagcagaatgtggacgatgctgtttatcagtaccagcatgaccgcaatcccaaagaactgctgtttcagttcaaacgctgcatggttcattttgcagtggacgatgcgcagatcaagttttgcaccaagctggacggaaaagccagctggttcctcccgtttaacaagggatataaggatggagcggggaatccgcccaatccagatggcataatgaccgattatctctggaaagacattctgaccaagcagaagctggcccgcattattgaaaactacgcccaagtggtggaaaaggaagacccggacaccaaaaagaaaacatatactcaggtgtttcctcgataccaccagctggatgtggtagagcggttgctggcggatgtgaaggcaaacggtattggacagcggtatctcattcagcacagcgccggttccggaaaatccaactctattacttggctggctcatcagctcatagggctggaatcggacgatggcgagctgattgtggacagtgtgatcgttgttacggaccgagtggttctggacaagcagattcgggataacatcaagcagttcatgcaggtgagcagcaccgtagcatgggcggaacattccagcgatctgcgaaaggcaattcaggctgggaaacgaatcatcattaccaccgtggagaaattcccctttgtcctttctgacattggcacacagcacaaggacaaccattttgcaattattatcgatgaggcccattccgggcagagtgggcgcacttcggcaaagatgaacctcgctctttctggattgtcctccgaggaagaacaggataatgaggataaaatcaatgccatgtgtgagggtcgcaagctgctgaaaaatgccagctacttcgcctttactgccacacctaagaataaaaccttggaaaccttcggaaccccctaccaagagggagataaaatcaagcatcgcccgttccatgtctataccatgaagcaggcaatccaagagggctttatcctggatgtgcttaaatactatacccctatcgacagcttttatcgcttgaaaaagaccgtggaggacgatccgctctacgataagaaaaaggctcaaaagaagctccgtgcctttgtagagaatcagtcttttaccgttgaacagaaggctgaaatgatggtcagccatttccacgaacaggtaattgccaagggtaaaattggcggcaaagccagagcaatgattatcaccagcaatatcgagcgttgcattgaatactactatgcggtcaatagatgcttagcagctcggcatagcccttataaagcaatcatcgcgttttctggggaaaaagaatttcacggccaacaacctgcgcttacctctgccggcctaaatggattcccggataacaaaattcaaaagaccttcaagcaggacccctatcgtttcctgatcgtggccgatatgttccaaactggttatgatgaaccattactgcacaccatgtatgtggataaaacgctctctgacatcaaggccgtgcagacgctctctcggctcaatcgtgctcatccgcagaaatatgataccttcgttttggacttcgccaatgattctgccacgattgtagaggctttttctcgatactaccgcaccacattgctatcggatgaaaccgaccccaataagctgtatgatctgattgctgtgatggaggagcatcaggtattcacacaggatcatgtagagaaactggtcaatctctacctcgacggtgccgagcgggatcgccttgatcctattctggatgcttgcgccgctgtgtacaaagaactggatatcgatggacaaattaaattcaaaagtgcgacaaaatcctttgtgcgtacttatggattcctgggggctatccttccctatggaaatcctgcttgggaaaagctttcggttttcttgaatctgcttattacaaaactgccgtctccgccagaggatgattttacacaggggattttagaggcgattgatctggacagctatcgcttagaggctaaggaatgtatttcccttgtgcttcaggatgaagacgcagaagtggcccctgtgccgacgggtcagattggagcaaagaaagagccggagatggatttgctttctgccatcttgaccacattcaatgatatgtttggcaatatagattggaatgatgcggataatgtccgtcgtcaaattcttgagattccggctatggtttccaaggacgagcgctaccagaatgctatgaaaaactccgataagcaaaatgctcgtattgaaagtgagcgtgctctgcagcaggtcatttttagtatcatggctgacaatatggagctattcaagcaatatcaggataaccctgactttaaaaaatggttgtccgacctggtgtttaatctgacctataacacagaggggaatgtttttctccgcccgcaataaggttatgcggaaaaagcgctaatacgattatggctttacctcttcctgaattcatttctgctcctcgttcagactaacccactggttgcgcaataaccctgcggccttgcttttcccaaacggaaaataaattgtgacgctggtcaccacccaaatatgaagaatggaacagttaccgaggaaatcgcgatagtttctcctaactccgactgctattggcgaggtgagttttgaaaaaatggattccgctgaaaaataattggaagtgtaagcacacatctattgtgtagtgacatttagaagggagtgaccagatggcagaaagaaaaatccgtgccgggtactaccagcggtacgacaggaaagtggtctatgtaatctctctggccaccgacgccgacactggcgaggaaagcgtcatctggaccgattatccccttgcggatgttcccagatactacacctccagcaaaaagtccttctgcgcttttgtggaagtgaacgttgagcggaaagccaggtacaagcggttgctcaacatgaagatcccggaggatgtcgttgaaaggctggaaggtgaaggcttccgtggccctgtgcgcaaacggcaacgactacagccggatgaagcatacgactcccacgagtaccagcagtctcttacctactacgcatacgcaaaagatctctgtgagcactacaacttcgaccggaacaaatatcgcctctgcgtgaaggaaaagagatttgccgccatcaccaaaagtgacttcgccaagctgaaagaggatctccagtttctggacaatgccctgaaaacggtgctggccacacaccaggattatttccgggagcggtttgtagagggcttgtggatccgcaggtacgcggatgcccatcagctgaaccgtggcagcgtggactgtcagcaaaagaaattcttctctgccctggctcgtctactgaaagaacgggacgaggcggagggaacatgccgactgaggaaaccagcacataagtaaataatccaacctcaaacggagcgcctgcgacaaagcagacgctccgtttttctgtcaagtgtatgtcaataggatatgattttcccaatacaagtagagaggcaactcggacaccatcgaaaaattgtgtcaaaactatgtcacatgcaaatgttctcgcctaaagaagtagagggagttttgagaaggagatggtcaacatgaaagaatctgtttacaaaaactatgacgaagcaaaggtgctgggcgtatcaccgtccagcgggtgtgaactgatacaccaaccggacttcacggtgctgcttgtgggcagctgcatggtggtgccgaaaggtaagtccattcagtgggtggaggagcatgcaggaggtgctatatgaagtttcaacagtggcccaaacgcgatcccaacaaaaactattttatggttcccaacgaagtgtttcacatcggcctcagtcatccgaagatctcgatctactgctatctgctgagcatcgaggacagagaaacctatcagtgctggcccagctacaagaccatcggcaaggcgctggggatgtgtgaaaacacggtcagcaagtatatgcgcagcctggaggagaaaggtctcatccgtaccaagccgaccatgatacgaagcaaggacggcaggccgctcaacggaaacctgctctacacaatctgccccatccaggcggcggaggaatcgttctaccagcggcagttccggcagctggaggaggatgctgcccgtcagagggcggcggagcgtctggcggaatccgcccgcagaagcccccagaacgccctgtgtgtgcctttcgaagcgggagcgagtcccagtgccgatccggggttggaggcccaatttggcccgctttcggaggtgcttccgggggcgaaagaaaaagcaggataaacgacggggcgtaggcaccccctgtcggaagcacaactgcccgcagtgcgggcagttgcgggggcttttgcggggcttgaaagtggggccaaaatccgggccgtgatatcatctctgcggtcacaatccccgaaagcctactgccacaaggaaaaaacaggggtcaacccccggaaaggagccaacatgagcaaaaaagagaaattcccactctacctgtcgccagagaaaaaagccatcctggagcgccggtatcaggaggacgggagccggagcatcaccgccttcattgagcgggcggtggactctacctcagcgccaacaacgccggactgtttcttcctacctccatcaagtcctatctggacggaaggatgggacagttggaggagcgggtgcgtgggacctgggaggagggcgatgagtggcaggattgattctgaaaagcccctacctgaagtgtgacggcggaaattctgtcagcggttatctgcggtacattgggaccagagagcgagtggaattgctcccggatgaccgtcctcccaccagaaaacaggagcagctcatcagaaaactggtgaaagatttcccttcatccaaggtgctgggtgagtatttggactacgaatccaagcccaccaaggcccatgcctccgcctttatcacccgtgcgttggaggaaaactgggctcaagttcagcagatggacggctacatgaagtacattgccacccggcctcgtgcggaacggcttggtgaccacggactctttggtgatgaagatgctgttgatttggagaaagccacgcgggagttggatcagtacaccggcaacgtgtggatgcacatcatctccctgaaacgggaggacgccgcccgccttggctacgacaatgtcaaggcgtagcggaatttgctccgcgccaatcgcaatgaaatcgcggccgccatgaacattcaacagaatcacttccgctggtacgccgccttccacgatgagggggagcacccccacgtccacatgatggcgtggtcaatggagccgggggaagcctatcttaccagagaaggcatccacaagatcaagtccacgctgaccaatcagatcttcaaacaggagatgctccacacctacgaacagaaatctcagtcgcgggatgagttggtgcgggaagcccgcaaggccattcggaaactcacacaagagatggccaagagcatctgcacagaacctgccatcgagcagaagatggagcaactggccgggcagttggaaacggccacggccaagccggaaccggaaccgcccgacccgcccgaggagagccggtgaaggtgataccgttcgagagagtcgggtgaaacaaacgaagcccaaggggcgagatatcgtcccttgggctttataattttgggttaactataaatcaaaagattaaagagttgtggaaccttcaaggtcatccgctacaatctcgacctcgactgtatcattagcggaatcttgatcgccagtgaagtctccttcaaaaaaccatttataccctcgagcacttataactttggtttcaactaaatcaaggccaccgccaataaacagcaccaacaccgggaacaagttttcccaaattgataatgccattgcttgcgaatttcgtaataaatctaaatcctattttttcgttgattttggtcaaaactttccctggaattttcttgatcaatccgttagtgaataacagaataaaaaacgcagaaaaaccgcctatttaggcggtttttcaaagaaaggtggtcgaggtgacaggattcgaacccgcggcatcttggtcccaaaccaagcgcgctaccaactgcgctacacctcgatgataacttagttatcataccatacgctttcatcggatgtcaagatattgttgcgctcctggtataataaattgtttagcgattttttcgctaaacaacggcgatcagatgatggatatgataagatgacaccggggtgatttcgttgtatgataggcttcgatatctccgaaaaaaacatcattggtcgcaggagcagcttgccaaacgactgtattgcagtcaacaacaatatagcgcatatgaatgcgggcatacagatataccagtatgggtattgttacgcctatcatccatttatcatacgagttgtgattatctgctcggcttaacggatgattcaacgccaaaataatcggaggggcggtgcttcgcaccgcccctcattttcctatttaaaacgcgattttcgtcttgagatagtcgcagagcgaatcaatggcaatccgctcctgcgccatggtgtcgcggtcgcgcacagttacacagccgtcagtttcgctttcaaagtcataggtgatgcagacaggtgtcccgatctcatcctggcggcggtaccgcttgcctatggaaccggcgtcgtcataatcaaccatatattcctttgcgagcgtctcatagattttccccgcgccctcagccagctttttcgaaagcggcagcacgcaagctttatacggcgcgagcgccggatgcaggcgcatcacaacgcgcacatcctccttgccctttgcgtccgtaccgacgacttcctcgtcatacgcgtcgcacaaaaacgccagcgccacacggtccgcgccaagcgacggctcaacaacataaggcacataccgttcgttcgtctcgggatcgaaataatcgagcgtcttgcccgaatgctcgccgtgccgtcccaaatcataatccgtgcggtcggcgatcccccacaattcgccccatccaaacgggaacagatattcaatatcggtcgtcgctttggaatagaacgacagttcctccttggcatgatcgcgcaggcgcatgttgtcctttgtcatgccgagcgacagcagccagttttcacagaagctgcgccaatactggaaccactccaaatccgtatcaggcttgcagaaaaattccagctccatctgttcaaattcacggatgcggaaaataaaattgccgggcgtgatttcattgcggaagctcttgccgatctgacagacgccgaacggcacctttttgcgcgtggtgcgctgaacgttcataaagttgacaaagatcccctgcgccgtttccgggcgcagataaagttcgcttttcgcatcctcagtgacgccctggaacgttttaaacatcaggttgaacttgcggatatccgtaaaatttgtgccgccgcactccgggcattgaatgttatgttccctgatatacgccagcatctgctcattgctccagccgtccgcgacctcgccggttgcgtcctcaatcagcttgtcggcgcggtggcgcgttttgcagtctttacaatccatcagcggatcggagaagccgcctacatggcccgaagcgacccatacctgcggattcatcagaatcgcagaatcaagccccacattgtaaggcgattcctgtacgaattttttccaccacgcgcgcttgacgttgttcttaaattcaacgcccagcgggccgtagtcccatgaattggaaagcccgccgtaaatctccgagcctggataaacaaatccgcggcttttacagagatttacgatcttttccatggttttttcgctgctgttcaaaatagattcatcctctcaaggttatattctaaataaaaactggccagggttccgattagaaaaaaaggccggaaggcggggagcttgcaggaagcgcgccagccgcgcggcgtctgtcacgcttcctgctgacgcagggtcccgcgtctgaacaggtgtcttgcggcctgcgggccgcgcttttatgagggctgcggcccggggataagggcgctgccctcggagaaggacaaaacccgcaaggggccttgtccttctccttcacccgccgccttttaaaaaaggcgggcaaaaacttttgaccgccgcggcgtaaaacgaattacgcagtgccttccccactgttcgcggcacagcctgtatcaacgcagcgccaaacccgctgttcgcggcgcagccggctaaagtttttcgccgaggccttttttcaaaaaggccggagcgcagccggctaaagttttttgccgagctttttttcaaaaaagcgggggcgcagccggctaaagttttctgctaggcattttttcaaaaaagcttggactggtcgaggcggtcaaagccgtcgagaagggtgcggacaacagcgcagagacggtcgcagtcgccgggacggttgccctccatattcagcggcataagcggatcatgcagtgacaaacgaagcagcacccagccctggacctgctcgctgccaaacgtcaggcgcacgccttcgtaagagttgggcgccacagcgtaaccggcggccctggcgcgctgctcgaactgctcgagcacctgctggccatatgctttaaagtcctctccgctgatattcatgcggtattcgcggcattcaaactgcctgggcagtttttcgatcagcgtatcgatgcgcttgccctcccggcgggccttcgcggccgcaatcaacagcttgacggcaagatatgcgccgtcgtccaggaaatagttttcactcagcgcgccatggcccgaggtttcaatcgccagcggcgactgtacgcccgccgcattgaggcgcttggattcgttgatcacatttttatagccgcgtttaaagcggtgatgcttgagatgcagcgtgttctccagaaaatcggtcagcttgtccgaggtcacggaatccgtaacgatcgtaccgcccggataatccggtgcaataatcgcggaaatcatcgcgatgatagcgtcgcggttgacctcgctgccgtcgtgcaggaccgcggacatgcggtcgacatccgtatcaaatataatacccatatccgcatgatgctccactgtcgcggcgcgcacagaatccatagcctgcttgttttcaggattggggatatggttggggaacatgccgtccggctccagaaactggcttccggcggtatctgcgccaagcggctcaagcacctgccggacaaagaatccgcccgccccgttgcccgcgtcgactacgatatgcagccccgccagcggacggtcgtaatcgtcggctttgacgccaaggcggattttttcacacaggctttgcgcatacaggctgatcaggtcgacctttgacaccttggaaatgtcggcctgtcccgccgaaaggacagccgccgtttcaagcaggtcggtgatatcggcgtgctccagtccgccgtccgcgttaaagaatttaagcccgtttcggttataaggcagatggctggctgtaatcataatggaaccgtcaaaacgggtttcagggaatacgaccgacataaacatggaaggcgtggacgcaagcccgcagtcaaacggctgcgcaccctgtacagccaacccctggagcacctgcaacaaaagcgccggagccgaaacgcgcgaatcatgtccaacaccgattttcaattcgctggcaggcttgcccgtgcgctgcgccagccacagcgcaaacgcctgtgcgatcaggttggcggcttccccggtcagattgacctgctgcccctcaacgccctccacagcgacgccgcgcacatcgctgccgttttgcagcttcagcatcagttcctttgaaatagacatcgtaatcctcctcaccttcgcttcatcccagcctgtgaccatatccggccgggccggcgcatatgcttttatgacagcagcccgctacgcacggcgctgcattgaccgccgggacaaaatcgggccgtgcacgcgcgctacggccatacgctgtaataatcgcttaccgcttattatagcaatgatttcccgatttgtcattgattgttttcataaaatcacgtaaaataaatctgtctctattgacaccggccacagcatacctctggtacgattgcatttgataaaggagaatatcatggatctgaccattgtcaactggatcgccacacatctgcgctgcccgcctcttgactttcttatgccggtcatcaccatgcttggggaatatgggtttatctggattgcagtctgtattttcctgctcgcacgcaaacagacacgccgtatgggctgcgcctgcgcactctcgcttctcattgcgtttgtatgcggagagattgtgctcaaaaacatcgtccagcgcgcgcggccatttacccacctgccggatttgacgctgctcattgcgccgcccggttcattttccttcccatcggggcatacaggctcgtcgttcgcggccgcatgttcgctgactctgtccaaccggcgaaacggatggtgggctatcccgatggccgtgctgatcgccttttcacgtctgtatctctccgtacattatccaaccgatatcctggcgggcgcgctgcttgggttgttcagcgcgctggcagcgtgttggcttctgcgcggcggcgcgcagacatagcaactgaaaggacatttattatggaaaccatcacaatttatatcggcggtacggcccacaggataccgtatgaagcgccccgaaccctgtccgcttttttagagccgtatggctttcccatgccgtgcggcggcgcgcacacctgcggcaaatgcaaggttgcggcatatggcgcgctctcgccgctgtccgaagcggaaaagcgcctgctgactgccgatgagcagctttcaaacgtgcgcctcgcctgctgtgcgcaggcgctcggcggctgtaccgtccatgcgcgcgcacccgaaaacgcccggattgaaacggccggcctgtccgcacagcgcagcgacgcctcgccgttcggcacggatggctatgcccttgccgtggatatcggtacgacaacggtggcagcttacctggtcaatctgacgcacgcccaacctatggaaacggccagcgcgctcaacgcgcaggcaccatacggcgcggatgtgatcgcgcgcatcgcgcgctgcgccgaatgcggcatccgtccgctccaggaggcgatcctcacgcagctcgacggcctgttcacggctctgctgaagcggcgcgaccttgatgcgcgcgttgtacgcggcgtcgtgctcacaggcaatacaaccatgctgcatcttgtagccgggcttgatcccgccgggattgcagccgcaccctatacgccgcagagcctgttcggcgtgatggaaagcgcgcgcagcctgttcgccgctctgccgccggacgtgcctgtctattttgcgccgtgcgccggcgcgtatatcggcggcgatctgatctgtgcgctgctcgcggcggcgccgcaggagaatgaactcttgatggacgtcggcacgaacggcgagcttgcgctgatcaccgggacgggcatcctctgctgttcgacagcggccgggcctgcctttgaaggcgccgggctttcacacggcatggttgcggccgacggcgcgatcacgggtgtttccatagcaggggacggcgttgttgtctgcacagtcgccggcggcggcgcggcgcgcggcctgtgcgggacaggcgcgatcagcgcccttgccgcattgcttgactgcaaagcggtcgacgaaaccggcctgctcgacgaacaatatcacgaatcgtttccgcttatggacggcgtggcgctgacgcaggcagatatccgccagcttcagcttgcgaaggccgccgtcgccgccggcgtcgactccatgctccaagccgccggccttgcgccgtccgatctgcacgccctgctgcttgcgggcggcttcggcagccgcatcgacgtgcggtccgccgccggtatcggcctgattcccccggcctgcgcgccgcgcgcgcgcgcctgcggcaacgcggccggggcgggggcctgcctgatcgcgtcgtcgcagtctgcgctcgacgacgccgagcgtctcgccaagcgcgctcaggtgctcgatctcaccgaaagcgccttcttttccgaccgcttcatcgaacaaatgctgttcccgcttttttgaaacttaccttttttaaaaaaaaggtaagccaaaaaactttagccggctgtgccgcgaatagtagggcgggtactgcgcatatacaggctgtgctccggcttttttgaaaaaaagcctcggcaaaaaactttagccggctgtgccgcgaatagtgggttaggcactgcgtttatacaggctgcgccgcgaatagtggggcagccgcagtaaatctgatttacgccgcgtcgctcaaaagttttcgcccgccttttgggggaggcggcgggtgagaaaatggccaaggcccctcacgggtcttggccgttttcaagggcagcgcccttatccccgggccgcagccctcataaaaagtgcggcccgcaggccgcaagacacccgttcagacgcaccgcctgcccccagcaggaagcgtgacagacgccgtgtggctggcgcgcttcctgcaagcactccaattccagggcaggttcagttaaacgatccccctccggacgtactggcgtgcgccccatacgatcgcgccaggcagaggtggggataacataaggggaggggtcgctcgaccctccccttgtgaggcgcgctgaggggcgcagccgcggcttgtccgcgcccggcgctatagcgccggaaagccccgaatagccagccgggcaagcgaagcgtccggcggtgagcaatccgcgcacggattgcgcgcgcccccggcggtgagcggcccgcgcacgggtcgcgcgcgccaaagcgcggcccgcaggccgcaagagcctgttcagacgtatctcccacccccagcaaaagccatgacaaataccgcgcggctggcgtggcttttgcaaactccggctttccgacctttctgaaaaaagcccccggcacgctgcctttcggcagctccgccggggacatcaatcaacccttattcccattcctgaatctcgggcacgtcacagccatagtcataatcatcccattgggcgcgataggcccgttcgattgcgcggcgatagatgcagtagccggcggtaacacagatcaccagaattgacaaaacaatcggcaccaccagccataaaagcgaaagaaacgtcttttccgtgctgtgctcatgcataaacatgcccccctttatccgccggatgcggcggcagaatgcaaaatctggctctatgatatcgcaaaaatgtctggccgtcaaccggctaaaaaacaaataacactgccgcgaaaacggcagtgtcgataagaaacaggtgtcacccggccgacccttcttatttggaggcggcggcgagctttttcataagcgcggactttttatgcgcggccgcattcttatgcatcagctttttcgcagcggcctgatcgaccttcttaatcgcgacgcggatcgcctcggcctgatcggcggcgcccgctgaaacggcggcgtcagccttcttcagaaccgtcttgaggttggtcctggcagccttgttcgcacgcgcttttttagcggcgacaagcacccttttcttggcggatttgatgttcggcataggtttacacctccttgcttggattgcataaaagacagtacaagttataatagcattctttttaccaaaaagcaatacctatgccgaaattttcccacaaattctgtcaccggaacataatatatacataggttacgtcctttgtatttagattgggcaccgatctgtttgtcgccgcgatgagctgcatgactgtaaatcccgtctcctcaatataagcgcccgccgatcccccctgcgccgcaacgcatgcagaataattaatcatatcacccgcctggctggccatgccgaccaaatttttatccacagcgaataccattccaaagcgcggctgaaaccccaaggtaatcaggcgttcctcctgtccgtcgcctgtataagaaccgatgaccggcgcggctgcgttccatgcggcgcgttcctgcgcgctcacatggacggtctggtcggcgcggtgtcccgctaaggcggtatcgatcaaacgattgtcgctgttaaagtcctccatctttggtttatccgaaccgatccactggttcagcccaagcgtttctgttttatttgtactggccatatcaaattgcctcctttggcgcgggatgccccgccgcgtcgaattcactccaagtcagcccgcgcgcgtcgattgccgccgcgtcgagttccattgcgtcaagcagcgcccaggtcagttcgccgatatcgagcgcggcggtcacacccacgggcagcaaccggcgcagcgcacgcatcagcgcgccgctgtcctcaaacagcccgccagacgtttctccgccaaccagcacccggcgctgcgcaggctgctcggtcagcctgaccgcacagccgagcatacgaaaatacgcctcgagcgcggcgcgcgaacagccgggcggatgcgccagcgccgcggccgcgcgccgcagcagcgtcccgtccaaaccggacgggacgccatacccatgcagcgcacaccaggctttgagcatttcatacggtgcggacagcgggtacagggcatctgttatgtccgacaaaagttcccgcgcccgggacagtcccgcgtcaagcgcggccaactcgttcgaaacagacgtacctggccgcaggtcgtaaattccagcggctgcggtgcgtgcgtacagactatgctccatttgaagcccccatctcctccaccgttataacgcccgcgcgcaatgcctgcacagggccggcagtctgatcgtttaaaggcgcgaggacgttgcagttttccgcttcgccggccatcacaagctgataaaggcgcgcgcgcgtcagcccctctcccagccgcttttgaccaagcagggcgcgtacctgcgcctcaatggatgcgcgtaccgtttcaaacggaatgtcctgtgcaggctgtacggtgatatgcacatcgaccggtattgtctgcgcatcccgcaccgttaccgacgcgcagagcgcgcggcgttcatcgagcgccgcctccaaagccattttaacatctgtcgggacctgctccatatccggcgccgtcacaagcagctccacatcgcccatctgcacgccggcctgtacagccgcgtcagaaataccggggaaattgcacgcaaaatcgcggtaaaacgccgcgttcacaccgttcggcggttcctttatcgcgtcgagcagccgtctgcgcagcgatgcgtcgttctccgtgtcgcgcccgcccgtaaacgcctccgggttcttcaccgaaatattcggcagggaagggtcgatctttaaaatccgtcccgccgccgcgtttcccgcgcgccccggttcacgtgcgcgcgcaggcacggatgcttcttcctgcccgtcgccaaacgccgcgtcctccagcgttaaataagcggtttggtccgcggcaaggcacaatgtcccagcaggcaccatttcctccccgccggttttataccgcttaaatacaagcgtacctgacgcatgcgcggccgcaatccgttcaagtccgcgcagcccggcataaagctccagccgttcgccggccgccgtctgaggcgcggcctgacggcgcgcctcgtcgagtacggcgcacacctgcgccagctccccggccagggcgtgaaagcgcagcgcaatgtccgacgcttcgtccggaacaaagcccgcaagctcctgataacgcgcggtcatacgcgtataaagcgactgttcgtcatattgcatcaaatccgcacctccaatcccgcctgttcgccgcccagatcgagcgtcacgcgcaccgccaggcggctgttttgcgcatcccattcgcttcgcgctgcggccacgcgcgcctgcggcagcggcgccaatgcgcgccgcgcatacgcgagggcgcgctcgtcgcgcgccgcctgtccgcctgcggcgggcaggcggtacagctcgctgccgaacgacggatcgtgcggcaggcttccgcgccggaccgccagccgtatcgcagcgcgctgtgccagctcacgcgcgccgccgatcatcaccggcgttccatcgcgcccgcacacaatgtcgccgttttccaataaaacatccatgcggcatccgcctccttttttaagctgttacacataccgtttgtccagcatggttaaaaaggtctgcgccccgtcctgcgacagcctgtaccgcacctgatggacaaacaggtcctcatagatctgcacgccggtatcgagccttgccgaatcgcgcagcgccacatcccaaaagccgggacagactgcctcggctacaaacttgccgagcatggagcggtgcacgcgcagagacgcgtcaagcctgccgcttgtaccctgcatatattccactgaagggatcaagtaacgtatgcgcgtcagtccgagcgcgtcagcctccggattgtcgtaggaatagctgtaaacgccctcctcatcgcggattacaaaacgcgtgatcggtgagtaacggttgtccgtaaccttgacgcttgaaaaacgcagcgcgtccgagacgctgtttgaaacaacaaggctgcccgccgacggccattcgctcggacagacgacacggccttcactgtcgatatacgccggcagggacgacgcgttgcgtgcaaaattataaaggacctcccactcactcatgcccttctgcacctggtaatggttaaaaattgcgttgttgtcgtacacgagcgtttcaaagccgtagggcttgatgtgttcgtcaaaaatccgctgcaaatcgacattcgtataaatccatggcagcgcctcattgtcgagcagcaccgctccgggtccgcgcgccagcagcttgagccgccgtcccgccgcgccggccgtcacgctcgtttcgtcaacgccgccgtaaaagagccgccgttcacccatgaccgcctcaaccgaatgaaaacccccgcacgcctgttcatacgggaataccgccgtaaaggagtcagccggcgaatcgaacgagcgcacaagctcccattcaaccggcggcggcagcgtcaccgccgcgccgtcgccgccgcgcgccgtcacagtcagcaccccgtccagcctcgccgtcatgacgcggcctccacgccatattcaagaaagtcgatcacatatgcaagcacccgcccgtcgccctgcgcggtgtatgcaaaccggctgaccgccgcagtgaattgctcgccggtcggcaggtacagcgtcccgcgcaggccgggcgcgcaggcagccgccagcgacgccagcctgtccagggccgtgtcggccgtatcgccgaagacctccccctcgcaccgcgccgtgcggcagcgcgggcctgtatcctgcatggcgacgcccgttcccggcaatgtgtgcgccgccagattatgcgcctgggacagctcaatccggcgcgggttctggtcgaacagatatgttccaaactgcatccggttcaatgaatcgcctccatttcatttgtaatcggatgcggatacctgcgcgcctgtgcacgcaggcggtcgttgaccagactgagcatttgcgtatcgtcgtccgccgcttcataataaccggaccgctccggcgcggcgggcatctgctcaggcgtataggcgatcggctgcggcgtgtagtccgcctgacgaaccgcttccagcggcgcggctggtgtggattgtccgttggccgccgtaatggatgcagtttcctgcgtttggcccacaggccgggccgtatccatatacagatcccatacaagcggcacatccatctttgccggataattgacagccgcgcgcgtctttgtaaagtcggaaaacaccttcatgttcgccgcaagctccgcttccagattcattccgtccccccagtctgtgcgtcccatgattcgttgaccgcgcactcgtcgtaccataccgcgtccgccggcgggcgcgccctgtcgaaggcctgatcgctgtgctcccaataaagacggcacaaatcagcaatttgacagagcgtaaagcggtcaagcgccccctcgggcgacgggacggcgtcctgcccgcgcaatgtctgaaacagcaggacgcagttataggcgagcgcatacgcctgcccctcgtcaagccccagcctgcacagccgcgggaccatctcccgcgcccggccctggtgcgccagccgcatggctgcgctctgcttttgaaaggtaaagtcccggccgagatagccagcggaaaacctgttttcggcaagcggtcccgccttcatgtctgcacctccatgcgcgtgcgcgccaccagcgtcagcgtctcatatacaaggtcgcccagcggcgttgattcatcaattgcggaccatctgcaatcagaataaataattttgctgcccgggcgcacaatcacaacgttaaagccgtcgagcgcatgaaaatcgacggtatcgccgtccatctgcggcgttacagccacgcgcgtcagctccaggacatggcgtacgcgcccgccgaccgtcccaaccggctcggccgagccaaacgcctccacatagcggctttcgcgcgttgtcctagctttgtagctctgtgccgtggcaaggcggcgcccatcaatttcgatatagatatccttacttgtcgggaatgtgataaatgccattgcctgcctcctttcgcattcaaacgacaatctccgccgcgacgacaatctgactgatttcaggcgcgacgcgcatggacagcgtcgccacacagacggacgcgtcgcacggatgcgccgtcacacgcggcggctcatagctgtcgattacgccgagcgcacgcttggcctcgagttccacagtgatttgcgaggcgatgctctcgcgtgtaaccgcattgtttttcagcccgcgcaggcgcgtgccaaccgcaccgcgcaccgcggtgacaaccgcgtcgacagccagcgccgtggacagcgcggcatgaggcccttctgacgcatcgccggtccgtccggttgtaatggcgcgcacacatgccgcgccctcaccgcgcccttcaaacggcgctacccccgcgcgcagaagcgtttcgatctgaacagccgtcagcattccgtcaaacggtttctccagacgcagcggcaggccgttgaggctgtttgtcccggcggcgttcgcggcggccgccgcgaacgccgccgccacttcggccgtgcgcgtccctgcgtcgcacgcaaccaccacgcgcgtgttgttaatctccgcggcggctgcgaccgccgcctccgcttcggcggcagccacgatcccaacgcgctcgcgccccatcgcacagcacgcatcgacatggcgcgccaaagctgcgcccccgccgtcgcttacaacggcaaagagatcgcgttccccctccagagcggcgaacgccgcttcataatccgcgccgacggctactgccagcacccgtgaaacgcccccagcaagcagcgcccgcgccatcgcgcacagcgtgctttcctcgccgaaggcagacgcatccgtataggaacgcacctccactgctgtaccagccggctcataaccggccttcgcctgtcccaccgccgcaatagccgcgcgcgtgcccgcggccgccgtaccgatgcgtatatccgtactggtatagacgccgggccgcatggaatccggcaggttaatcatcgcgctccatcctttccgcatgaaccaaaatttctttaaacggcagcccgtccgtatccggctcctcattcaatatcccgttgagaacagcgcgcgctgtcaaagacaggcaatcaagctcctggtcatacgtcagctcgccgcactcgatctgcgccgcgccgaaggcattttcacggcaaaacaacaggccacacagttcctcatagaccgcgtgacaacccggctgctgcccaaccgggcagatgatgtcaaaacgcatggtcagccggacgcgtccgcctgcgtcgcccggccggctggccccatccaggccgacagccacacagcagccccgctgcggccgtttttgcagcccgggcggatattccccggccacctgcacatctccagctgttgccagcctgccccgtagataacgcgtcagatcatttttaaacgccgtcagtgcatccatcctccatccctccttcaatcagacgcgcttccgcccatctgaacagccccgcgcccccgtattcaaaatcatgacaaatcaaaatttcatagagcttttgcccggtcttgatcaccgcacccgcacaaacatgctctccgccgcctgtcaaaggaccgtagtaaaagaacctgcgcggatccgtccggccaaaccgcgtatatgtgccctcggtgcgcatctgcgtgttccacccggccggctggatacttgcataaaaccgggcctgtttgtcgccctgcactgtgacaagctggccgcagacccgcagcgcctcattgaccgacgtttccagattcacgttccatcacctgccacagtcccacgtgtccgcgcgcgaaaagcggcgcggcgtccgtgaacagtgcgtcgcgcagggcgcgcgcttcctgcgccgaactgccctcctccgagcgcgtcactgaaatatctccaaccttgaagctctgcgcattgccggtcgaacgcgccagcatatatcggtagttcgcttcgccggccgcagccaaaatcagccgcagcctgttcgggtctgcatccactggcaaaagctcctcgatgcgttcggccgccgcttcacacagcggggtccattcgcgcgcagcctgctcgtcaaggccggacaggcgcataaactgttccaatacggcttctatttccaaggatgtttcctccttttcctggttctgcttgtgagggcgggggaacacatttcccccgcacccccattgcgaaggcggcgaaagaagccgctttccgcggctttcgcgcgcggcggccgccgcacgcgtgcgcgggcctgtccggcccgcgcctttcgtcgcccagctccccggtcacttcttgagctttaacaccttgacggcctgcgggaacagctttgcgaacccgctgatggacgtgacagccgcgcgttcaagctgcgtgtcgatcagcttgtcataatcgaccaggatatctccggccgtcaccatctccagcgcgaaattcttgtcgagcgcgacaatcgtcccggccggcgcggcggcacatcggattacattcgcgccgagcggggtgccgatcataccgctgccggaaaaattcagtccagcgaccgggtcgcgcagctcctcaatggccagcagcttctgcatcatgtcgggcgcgacaatcagcgtgttcatgcggaaatcttcaaactgggaccagagcgcaagcagatcgtcatatgtaagcgtgccggcctgcgcggtttcgatggccgccgccgcattgccgtttgcgtcatcggtggcatcaccgttgatgagcgcgttgacagcgtcagcaagctgcgccttggtaatgttcataccgatctgacgcagcacaaccgaaaacagatcaatcctttgaaatttgaccgcttcatacgacgccaccagcatccggccgcgttttgtcagcttgacaagattgtccttgagcttcacgaccgtctccgggatttcggcgccctcctgcacgacggacgcggccgtatcgtgtccatcggcagtggtgatggtgcggtagtcgagcgagttaatcacagtctttgacgcgatgatgttggaaagcacgccgctttcatcaacgccctgcatcacagcgcgcgacacatattcgggaaacaaagcggcagaatcgcctgttgaaaagaatttggagatcgtgtcgctgcccgcgccgctcactttgatgtcaaagcgtttgagctgccgctcaaacgcgtccagcccggccagctcgccgcccgcatactgcgccgacggatcgagcttttcaagctgtacggtaaacggaatccccgcgcggtacatagatttgtcaagcttgattgtctgataattcgccatcttttttcctccctgttttgtcgttcattcttcgaaccttcactaaaaggctgcgccgtttgtttaccgctgccttaaatccggaatacgccgttgtcctccggctgcatattttccccgcgtccaagctgcagaaacgcgggcgctttttctgaaaagcccttgcagaacgcctcaagctgccgtgcgtcgagccgttcggccgtctctgcggcggccgccgggtcaagggcaggcatggcgaacgcggccatgcgaacaaaatcacggcgtaattgctccaagcgcgcgcggccctcccgagcaagcgtctccaattcagacaggcgcatatcaagcgcgtctgcctgggcctttgacagcgtcagcgatccgtcgggcgcacgctttggccgcgtgttttctgaagaatatccctttgtaacgccagcttgcttctgcgcgggaatggccacgaacgaccactcataagcgtcggttggttcaatcagttcgtgccagcaaagcgtaccgttatactgctggcctgggatatgcgcgcacggttcgtttcgggtatcggccccgcagatggaacagaccgcgcccttgacagcgcagccgacgctgacttcctttttaattcctgcgtcaatctccaaaatgaggtcggcattttttgcgcagcgcaccatgtaagcccacgcgcgcagcgcgcagtatggctcattgttttgtgtgtgccggtgtgtgtcgcattcaacggttgtttgaaagatgcgtgcggtctgattttccccctttggattgtggtcaaaaataccggttttgccaatgaacagcctgccaagtacctccaatgactgccgtgggaaccgttcataatcgcggtcaatctcattgtcgcagaggatcatggaaaaaacataaacctcgtccgcagcaagcggacggcgcgcgaacgcgctgatctgctcaagctgttcctctgtaacctgcgcgctgtcaacagcttttgtcaccattgcgtgtttcatatcagccctcctgtctgttttcaagttgcgtctgcagctgatccgcccgcagattggtcaggcgcgcgtttgcaagctccaattcatcctgcaaattgatgttctcccatacgatgtccacgccgcacgcatagccgcgcaaacgcaggaatactgtacagattttgaccaatacaggcgtcagcaggcgcctgtagctctcaagctctgaggtcaggatatccgcctgttgggcgctcatgcgctcagtggtggaccaattcagcccaagcagaaacggcggcacaccaagcttggcgacgatctgctcgagcatctgccgtactggcacctcggttgaaaccatttggctgtctgcgccgatcaccttgatatcaacgtcgcccacagcaacaaaatcccgaattataccatgtcttgctgcatccatcgcatcagcccattcgcgtgcgatactgtccgcgatctccttggcccctgtctgatcgggcgcatcagggccggggcgatatgtcaccgcatagcgcagattgcccatgcgctcaaagttctgcccgatcgaggcgtatattttcataagtatatcgcatacgaacggcaatccccgcagcaaggagcatccataaacctgaccgggcggcggatccagcgcagagaacaggatcagttctggatacggcgcgggcgccggcgtaatcccatccctgtatacataaatttttgcctccagcggcgacgccccctgacggatacacacatctgaaagcggcgcgatgtaaagccctgccacagaccggccgtcggccgccgccgcaatctcgccgaccgcattgccgtaggtcagcaggctgtccagataagaccggataaacgcatccatgccgcgtgcggcggccccgacacacacatctctgaaaaaagcctccagctcggcctgcgcccgctggtcagtgcagattggcgcacagccgccgacaagacgcccgattttgccgatggccgcgtcaattacagggatcgactggcgcagcccgtcgtacacggcccattcccgccagtgcggcggctgtacggtatctgctgccgggcgtccgcgcgctgtctgtacagcggctgcggcggtctttttcatacgtttccacaaacgcattttcatcttcctcctcccggtacgggggaacccaatcgtttcccccgcaccccttttcgcgcccgcgcactgcggcgcgggccttcgccgcctgcccagcggcttacccaatccccccggcgctgcgcgccgccccccttttccaaaggggggccgtctcccgtccaaccccggccacacagaagcctgtcccacggcgctcaagcacggtcgacacaaaataacgcagatcgtccatggcgtggtcgtcgcgcttaagcggcgtgtcgcggccggcgcgctcatcccagcggtacaggccgaattcccgcagaatatccgcacagcaggcgcagaacaagagccgtttttcccgcaggcggcggctgaccgcctgaatgccttcggccacttcattgcgggcaggcacgacgcggaaccggccgtgacggcggatacaggcgatgaagctggcggccgacggatcgacgatcacagcctccacccgcctttcccccgcgagcgcggcaagcgcctcgtaatactgctcatcggtttttacctcgcctgtacggcgcgaatcgtgataatattccgcaatgcggtaccatacgccgccgctttcgccccacagcccaaaggacgccgggttgacagtcccataatcgcacgatatgtagaagcgtccgcattgcggcgcgtgctccaccacatgtacagccggatcaaacatgggataaacagcgccctgcgcggctgtccactttccaagaacaaagcggtcgtaaaacgtcccggcatacaggcgttcataccgccgcagcacggcttcggaaagcgaaggattatctcgcatggtaaaatgcaggtaaagcgcgcttttctcatgcgcttgtaaaatccattctgtgtaaaaccagtgctgcggatgctccggattacaggaaaaccaaaagcgcgcgcgttcatcggagcagcgcgccaatgcctgttcgacaaaggaacgcggcatcaatgccgcttcatcaaataacacgccggaaagcgtagcgccctgaatcagcgcggcgctgccctcatcccgcccgccgaacagatagaaccggtttttgcgccgctttcccgctacgtcgatgtatccgcgcgcgcggttctccctgactgtgtagccaagcccgcgcagccgcgcacaaagcggatctgtcacattgcggcgcaaagcgccggcggtttttccgcagaatgcaaagtcgcatccgtcaaaatccgtcatagcccacagcataaaccccagagagagacaataagtttttccgctgcgcaccgccccgtcgcagatcacagcacacaggttttgatatggactgccgggacaccaccaggtaagcgcggcaagctgttttctggaaaagcggcgcgccttatccatgacccgccggcgcctccccatccgtcccaagcgtgcgcgccgaaagcgacagcgcctccagaagcgcgtccccgccgcttgtgccgcccatctccgccagcatggaaagcgcgcgcaggcggtcaaaaaatttgatctcgacgccgcctgttttcgccagcttcacctcggccgcatggaacagatcgcctccggcctgctgtccgtccaacgcgccggaagcgtcgccaagcgcgatgcgcgtcaatccggcgcgtgccaatgcctgcggcggaaacatctcgtccagctgtgcgcgcagccgcgcaattctgcgccgcacgcgcgcgcggccaagcagtagattttccatgtccgcaaggccggagcgccgcgcggcttcctccggtgaaaaaccgcgcgcggccagcacacaaaagtgagtttccttttgggcatcccataaacgccccacatgtatcacacccctttcacccatacccgcgcacaggccaaaatttgcgcaaaaacgcaacttttgcgcctattttcaaaaatttttttcggcagggcggtatcagccacctgcgcttgactaaaccagcgaaagaatggtacattataaaaggaatttcctgcatttttgaaaaaaggcccgcggcgcgcgcggccctgtccgggccgcacgccaccgtccgccccggcggccggcggctcatcgcatgcgcgagcgcgcctctttatagaaaggaacggccatggcgacactcaatatcgtactgatcgagccgcagatcccccaaaataccggcaacatcgcgcgcacctgcgccgctacgggcgcacgcctgcatctggtcggaccgatgggctttgaaatcacggatgccaaactcaagcgcgcgggcctggattactggcatctgctcgatatcaccacctatcccgacagtgcatcgttctttgcacagaacagggggccgttttattttttcaccacaaaggctcggcggacctataccgagccgcaatatccggacggcgcgtacattgtatttggccgcgaggacgcggggctacctgaggagcttttgttccagaatcccgattgctgtgtgcgcctgccaatgattgccggggcgcgcagcttaaacctgtcgaataccgtcgccgtagcggtttacgaggtgttgcgacaatgggattttccaaagcttttaaacagcggcagactcacgcgctttgactgggaggcagccgggccgtccgaataacaggaggatgcatatggcaaagaaaaaaaacgaccagaacatattgctgatgacggattcggccagcgatatcgccgacagcgacctgcttgacggcggcattgtcatgttgccgattccaattaccatcgacagtactggctatctggaacgcgttgattttacaacaacggaattttatgagcgcatggcaggcgccaaggagctgcctgtcacaagccacatttcctcgctcacctacgcgcgggcctatctcgatgcgtttgaatcgggctatacggatatcatcaacacaacgattacctcagtcggttcgcatatgttcgaggcggctgtgctgggcaagcgccagttttttgaggagcatccggaagcggcaggccgcatcaatatcactgttcttgattcaggcacctatacggctggttatggctatccgattgttgaagcgtcaaagatggtgaaaaacggcgcgtcagccgatgaaatcgtcgcctatctcgacgatttctatgcgacagttgaaatcgtgttcgcctcctattcgcttgaatatgcaaagcggtcggggcgtatcccggtcgccgccgcgtttataggcgacgtacttggcctgcggccgatcatctcgatcatcgacggcgtaaccaaggttgtggaaaaggtgcgcggcgataaaaatgtcgtgacgcacatcgtcgattacgcttatacgcgcgcggctgacaaaaaatcgccgaccgtcgtgatctgcggatcggtcgggcagtacggagacgacctgcacaaggctgtttccaaaaaattcgggcacgcgccgcgcgcccggtatcaggcaggcgcatcgattgccatcaactcggggccgaaggtggtcgccatgctggtgcggggagaaaagcgcatcaatacgcgtgcacgtgaacaggatttttaagcctgtttacctcctgccaaaggaactggaaagcgcgccgggaagcgtgcgcttgcaataatctccaaagaaaggcccgcgcagcgcccaaagcctgtcgaaaccggggaaaattgcgcaaaatgcttgcaaaaacagtccccatgatttagaatgtttcatggtataaatccacaatcaaaccggtacggattcatctgattttcataaaatgaagggtggaaaaagcaatgaactcttacaacaaaaaatcagtcgaagatatcgacgtctccggcaaaaaagtactcgtccgctgtgatttcaacgtcccgctcaaggacggcgccatcacctccgacaagcgcattgtcgcggcgctgccgaccatcaaatatcttttggagcatggcgcggctgtgatcctctgttcgcatttgggccgcccgaagggagaattcaagcctgagttttcgctcgcgccggtcgcagtccgtctgggcgagctgctcggcaagccggtgatcatggccaaggatgttgtcggcgaggacgccaaagcaaaagccgccgcgctcaagcccggcgaactgctgatgcttgaaaacgtccgctttgaagccggcgagacaaagaacaaccccgacctggctaaggcgttcgcttctctggccgagatctatgtcaacgatgcgtttggctccgcccaccgcgcgcacgcttcgactgcgggcgtcgccgattacctgcctgcggtctgcggctttttgatccagaaggagattaccgtcatgggcaaggcgctatcggacccgaagcgtccgtttgtcgccattttgggcggcgcgaaggtttccgacaagatcggcgtcatcaacaatttgcttgataaggtcgacacgctgatcgtcggcggcggtatggcctataccttcgccaaagcgcagggttattcaatcggcgattcgctgtgcgaggacgacaaggttgagcttgccagggaaatgctcgaaaaggcgaaagccaagggcgtcaagcttcttctgcctgtggataaccgtgtcggcgacaaatttgacgccaattgcagcgtcaaggttgttggcagcgacaatatccccgacggctggatgggcatggatatcggacccgaaacggaaaagctgttctgcgaggcgatcaagggcgcaggaaccgttgtctggaatggcccgatgggtgtgttcgagtttgacaagttcgccggcggcacgcttgcggttgccaaggcggtcgcggacagcggcgcggtttccatcatcggaggcggcgattcggctgctgccgtcgccaagctcggtttcggcgacaagatgacccacatctccacgggcggcggcgcgtcgctcgaattcctcgagggccttgagctgcccggcatcgccgccctcaacaataaataaagtgcgcaaagggcgggcctctgcccgcccttgatttttttcaagctcttaaaagcaatgctttttcatgtgccagaacagaatattgggaggtcaacaaaatgaataaagcccttcgtcaggcggttatcgccggcaactggaaaatgaacaaaaaccgcaaggaagctctggagctgatccgcgagcttggcccgatggtcaaggacgcgtcgtgcggcgtggtcatctgcgtgccgttcaccgatctggagacggcgctcacctatacaagcctggaggcaaaaaatatcaaggtcggcgcgcagaactgccattgggaaaagtcgggcgcctataccggcgaaatctcggccgacatgctcgttgagatgggcgtcgaatacgtcgtcatcggccacagcgagcgccgccagtatttcggcgagacgaacgctacggtcaataagcgcgtgcgggccgcgctcgacgcgggcctgcgtccgattgtgtgcgtcggcgagctgcttgcgcagcgtgagcttggcgtcactgatgaaattgtcggactccagacaaaggcggcgctggccggcgtgaccaaacaggaacttggccgcatcattatcgcctatgagcctgtctgggccatcggcaccggcaaaacggcgacggccgaacaggcaaacgaggtctgccattacatccgcgaggtcgtcgccggtctttatgaccgcgcggccgccgacggcctgaccatccagtacggcggctccatgaacgcgaaaaacgcggcggagctgcttaagcagccggatgtcgacggcggcctgatcggcggtgcgtcgctcaaggcggccgacttcaccgcgattgtcaacgccgcttccaactgacggcggcgcgttgaatgataataggaggtacccgcatgaaaaaacccttggcgctcattatccttgacggattcggatataacccgcgcgattacggcaacgcgattgcagcggcgaaaaagcccacgattgacagcctgtacgcaaactgcccgcataccctgatcggcgcgtccggcatggatgtcggcctgcccgacggccagatgggcaactcagaggtcgggcatacgaacatcggcgcgggccgaatcgtctatcaggaattgacgcgcatctcaaaatcgatcgaggacggcgatttcttcagaaattccgccctgaccgcagccatagataattgtaaaaagcacaattccgcgctgcatttgatgggtctttgctctgacggcggcgtccacagccacatcacgcatctttacggcctgctgcgtctggccagggacgccggcctgcacgatgtatgggtgcactgctttatggacgggcgcgacgttccgcccacctccgggcgcgattatctcgaggcgcttgaggcggagatgaaccgcatcggcgtcggccgcatagccacggtgatgggccgctattatgcgatggaccgcgacaaccgctggacgcgtgtggaacgcgcttataacgcgattgtcaacggcgagggcaattttaacccctctgtcgtcgatacggcggaaaagtcgtatggggcagaggtcacagatgaattcattgagccgaccgtctgccagaaggacgccggtgttaaggataacgactccatcattttttataatttccgtccggaccgcgcgcgtgagctgacgcgtacctttgtcgatccacagttcaatggttttgagcgcaaaggcggccaaaagcatgtatttttcgtctgcatgacgcagtacgacgcaacaatgccgaacgttgaggtggccttcaagcctgaaagcctgacgaatacctttggaaaatatatctccgacaaaggcatgacgcagcttcgcatcgccgagacggagaaatatgcgcacgtaaccttctttttcaacggcggtgtcgaggaaccgtatcccggcgaggaccgcgcactgatcccgtcgccgcaggtcgcgacgtatgatatgcagccggaaatgagcgccttcactgttactgacgaagtggtcagacgcattgaaagcggaaaatacgacgtaattattcttaattatgccaactgcgacatggtcggccacacaggtgtgttcgaggcagcccgcaaggcggttgaagcggttgatacctgcctgggccgcacattggccgctattgaaaagatgggcggccgggcgctcatcaccgcggatcacggcaatgctgaccagatgtttgaggacgacggttcgccgtttaccgcgcataccaccaaccctgtccctctgtttttcttcggctgcaaagatgtaaagctgcgcgaaggcggccgcctggctgatctggcgcccaccatgctcaagctgctcggtctgccgcagcctgccgaaatgaccggcgaaagcattgtcctttgataaaaatcgtttaaacccattttttacagcccgacgtctctgcccattctgcgggcagagacgttttcatcatcgcggatgcaaacagtttgatgcaagagcgtcgcgaaaagagcaagctgcggtcatttcagggatgtttacgccgccgcgccggctcaagccatacgccggagcgttcggctttttaaaaaaaggcaggcgcgtatttttttgactgctccggtacaaaataaggataatgacttgtcaacatccccaaaaaggattataatagggacaactaaccgcagcctcaagaatttgttcaatagaggaggacccgccatgagaaaaggtacatttattgcaaccgtcgcgcttctgatcgcgatcgccggggcgatcgttgcgtttgccgcctatttcaagcgccgcagctgcgcgctttgcgatgatctggacgatgaatttggcgacagcgatctgtacgatatggattattatgccacacaggtcgacgacgcgcagccgcacagcgacgaacaggacgctggcgatactgctaatgttcttgccgacgacgatattcccgacgaggaataaactgtgttcatgagatgaataaaagcggacctgcgctttcgcgcgggtccgcttttattcattttttattcctcaaacagctcccggagcatctgtccggggttgtttaaaaactgcctggtcagcacataagcgtccgtatcactgtaagaaacgcgctccacgcccgcatgtgaaaactgatagatcgccgcgtccgggtacgccgtcaaaaccggcgagtgcgatgcaatgataaactgcgagccgttttgcaccagtatgcgcagccgcgcgagcagggcaagctgccctgtaacggacagggcggcctccggctcgtcgagcagataaagcccctgaccgccgaaacggtttacgacgagtgaaagaaaactttcgccgtgcgactgcgcatgcatggaacgtccgccgtagctgtcaatcagccgcgggccaagcggagtttcgcggtcaagctcatcgatctttgtggcaacgttataaaagctttccgcacgcaggaaaaaaccgtcccccggacgccgcgcacccctgacgatgtgcagcgcctgccacagcgacgcgtgcgaatcacttgttttaaagcaaaaattgcgtgtgcctccctctggattgaagccgcaggcgatggcaatcgcttccaaaatcgtcgattttcccgaaccgttttctccaacaaaaaaggttaccggcgcagtcaataccagtttcccaagccgccggaccgccggcagctccatcgcatagccgccgtccgcgccggctttcaccgaaatttcccggataaacaacccgtcgggcgctgtcgctcctgtattgacagtcccacgtctgtccgatgcttcatcaaagcctgcggctgcgccgcgccgtttcacagctcgagtatctggccccggtgcgtgtatgaaacgatccggccgcagtacggcgcggccgccgggtcatccatcagcttttggcacagcgcgtaatcatcccatagatgcattggaacaacatgatccgcgcccacccggcgcataaaataatcgacgccgaggatatatttatcctccaggcgcgggtcgacgggtataaatgccgtgtcaatctgctccccctgcaaaagatcgatctgttcccggtaatgctggcccatgccgtcattatacgccctgctctcgccgttccagtgccaccagttaagatcgccggcgtgaaacacacagacgccgttgcatttaacgagaaatgcaacgccctcatcgtttgaacaaagcgcgcggacctgcgcatcgccggccgtcctggtttcacccggccgtatgcgcaccgcgcctgtgcgcattggcacgtcgtgcgataaaatatagtgaatttgcccggcccatgcctcccattggaaaatgaccggattaaaatggtcgtggtgtatatgtgaaacgaacacatacacgtcgcgtcccttaagcgcggacgcgtcaatcacaccgtctttcaaagtaccgccgcgcggcgtatccttataataatcaaagatcattacaggcccgccggtgtcaaccaaaaaaccgctgtgcgccagataaacggctttcaacacgcatcctccttttgatttggcttgtccttccaattccaccatttacatttttcaggctccggtatgggcgtttcagcaaagtagacagcacagcggtagacatacagcacacacctgtccagtatgccgccgcagcgagcgcaatcgcgttcataaagcgcctgcgggtcctgcccacgaagcgactctaccgtatcaaagccaagcgcatgcagatgcgccgccatattcggacccactccgggaattttctcaagctcagatttcactgccggcctcctgattcattgagcgtaaaacgccacacgcacctgttttccccgtcggtaatatcaggataacagcttacacactccgtttgaatacggcagtcaatcacgcgtgcaaagtttgtatattcaacaagtcccaccggcttgcatggatgaaacgccatgcccttgcgcgcgcgggcatcctgaacccggcaggtcttgacgcaataagtcagcgtatttccgtcaagtacagcctcatgccggttcaggggcgcatacagccggaaggccagcgcgcggcgcagcccgtccagccccgcctgtaccggcaggccgagaaacgctttgatacgccgcgcctccgtttcagtaaagcgcgcccaagcgttgacatcatgttcgaccgcttcgtccattccccgttttttctcaatggattgaaaccacagcccgtcaagcgccagccaatttttcgcgaacatttcgcacagctcaatcagttgatcgcgcggcagctcatcgatacgctcatacttcaaatttaacatctccctcctggctttcagcccgcccggctgcgccgcaagcggcaggcagatacttcgctgacgcaggctgtaccaacggacggcaggagagcttaaccgtttgtatcctgtactccggcacagtccgcacacctgccccattcatccaacgacaatctgctcatcgtttttaccaatacattaaaaatcgcctgtttttcccgcgtgcagcaaaagctgtcgttttctatttctgttcgatatcccttttgaccgcatacgcagcaggaatgaatgtattttttagccgcaggattccaacggtcaatatacagtgaacggccccgttttatcagtttactatgtgacaacggcctgcctcctgtcatatcaaagattgatccagcgcaatgataatgcctttccggattctctctccggcacaatcacaagttttacaattgtatactgaatttttcttgttctgcacattcattggccgcaatcagcacatgttcttttccgaaccccggccgcgcgactgctcccagaccttttgagcggcgtggcaagcagccactgcatcgctgcgtgtaccggccgcgatcaaaaaccggttgttgtgacaaaagcgcaatgtcgcgataccagacagctttggcagctcctcctcgctgcggccagcccaatcagcagggaagggaatcttgagcgcatgagtctcatcgtcagccggcacaccctgcgcgctgaatccgccgcgctgtgagggatatacgacaaactgtgcgtcagaagcggacaacactgctttccacggcgcaaaccgttccaatgtgacaacgccacgcaccataccgcgcagagcttcctccacatagctgcgcgcgcggcacatgctccgcacgctttccaaacgtttttccaaaatcacctgtgcgaacgaaacagcctcccaaaagcatctgtcagccggctccccgctgtcccatccggggttaaacaacgcgatcaaaccggctgtctcgcttccacaaccggtattgtcgtcgagatcaagcggctggataaaatgctgatcaaaccgcgcggcttcctccgcgtccgggatgagccggtcgccgaacgcgcgccataaaagcccaaacgcggcatatggcacgccattttcgcggacaggcgcgccattttgatgatggtcgaaatcgccgccgccaatatcaaaagccaagccgtcaaagttctccggcaggcgcataacgcgccgaatcttaattttaggattcagcaatctgagcagtgccgaagaaaatacatcatcagcatgaaaacgtccgccatgcgtcacagcggaattaggaatcattgtcatgttatgttaccttcctgtccttcatccccacacgcgatgagcgcgcatttttgcgcgcgtgtcatccgcttgatcgcacattcccgcctcatagccgcgctttttccgttgaaggactcacaataaacaagggtgacaggccggcgcgcacgggtatatttagcgccgcgtcccgcattgtgcattgtcaggcgccgttcaagatccgttgtccaaccagtataaagcgtcctgtcggcacagcgcaggatatatacataataaccgctctctgtgtccaagccatcgccccctgatcgcagcattgcctgcctagcagtgggctgacaggcatataaacaataccatgccgctttgcgaacatgatataatcggccatcggggcgcaagcgagccgccctggccataccatcaaaaggcggttgccgcgcaaaagcggcgagccgttgggcatagcccggtataataaccgctttgcggttattataccacagcaacaagcccattcgggcttgcctgccgcaaagcggcagtgaaaccggcaaagccggttttggctgtggtgtaacatgcgcagtccgctgctttgcagcggcagccgccatatggcggctgcaaacggctttgtcgtttgcactgcgcatattataccatgtccgcgaagcggcatggtataattgcccatcaaaaggcggttgccgcgcaaaagcggcgagccgttgggcatagcccggtataataaccgctttgcggttattataccatgtgcggcacactgccgcaagcgggaatgcccatacctatatcattactttcacgcagcttcaagctcccgcagatcagccagggcctcctgttctgtgtcggccgaaaacaggaacgcccctgtccggtcgaacacttctacatgcccgcgtacccattcaatcgtatattccatcatgaccgacactcctttcaaacagtcaggccctgccggcgtccatcagcggcggacgcccatatcgtaccggcgctgtgcacggtatcccgcgctggccgccttattgcattgccgcatcataaagcggtaaaatccaaatgacgccgcaaaccacagtgcagctccaagcattgcgatcactcctttcactacctattttacagagcattatgtcccataatccgtacagtttgattcatacaaaaaaatcctgcgtgatgcgctatcgcctcacgcaggattttttctctatacattttccattgcctctgtccacacggcaatatttttttaccgggtttcaaaagcgcgaaatctcttttccaggccaccagcaaaatccagccagccgcacggcgtctgtcacgaattttgctgggaacaggcggcgctctcccgcaggtgtcctgcggtctgcgggccgctcaccgccggccgcttcgcttgcccggccggctattcggggctttccggcgctataggcgccgggcgcgaacaagccgcggcggtgccccttttcgcgcctcacggggcaggggcgggcggcggccctccccttatgttatccccgcctctgttcggcgcggtcgtatcgggcgcacgccggtgcgttctgtggtaaaccgtcaagccgcccctgacccatggatctaaccccgtggcaggtgcagcctgcatacgcgcagtgcccgccccactgttcgcggcgcagccgagtaaagttttttgccgagctttttttcaaaaaagcgggggcacagccgactaaagtttttttggcttaccttttttcaaaaaaggtaagtgttcaaaaccatgcgggcaaggtcgcaaagctggcgcgcgacatgcggcggggaaacgattttggcctcgccgccaaagcccaacacccaggagagaaactgcgggctgaccgccacagacacagttgcataaaacgtttcgctgtccgcgcgggaaataaatgcatcgcggccaaaccgatcggcgacaacgccggccaaacggtttgaaaaccggattttaaccgtctcctcctcgccgccgaacataccgaagatttttcgcgcgtatacagccatatcaaacctttcaaactgtgcctgtccgtcacgcgacagatcggtcagcgcaatgccgtccatcttgtcgacccgataatgcttaatcatacccgcttcggaatcatacgcgacgagataatagttttcatcatcccaggtcagcgcccaggggctgacgagatattgcgcgccgccatggcggtactgcttttgaaacggcgcgccggcgctgaaatcaatcgtccactcaaagtaccggaatgtaatacgtacagcctgcgagatagcggtatgcagcttgtcgatgttgtaataaatgctttcattcatcgccttgacacggtttgaaacatagacctgacgctgtagaagccgcgcctgatgctggcttgcaaggctttccacctttttgatcagctcagtcgatttcttgtgagtaataaagcgcgatgactgcacagcgtcgacaagcagcttcagctccggcagctcaaaaatcctgtcagcgacaaaataacgccggcccgtgcgctctatatcaagcccatagagccgcagcgcctcgatatcgtcatacaggcttttgcgctcggcagatatgccaaaccctgcaagcgaagcgatcagctccggcatggtcatgccgtggtcttcgtcggtgttctccagcaaaattttcatcaggtacaaaagcttcagcttttgattcggatttttagccacgcgctttccctcccagtcagcgaaacagagccgcaatatccttctgcacgctttgttcaaacggcgtcagctggcggtcggccgcagaaatcagcgtgatattccaggcaaattcaactgtgtcaaacggtacgaacacaacccccgggcagtcgttcattacacgcggcaggtcggcgctgacgccgatccatccattttccaggcagcgccggtagatcacaagcgtttccattgtcgtttctgcgacgtcgggcgtaaaaccgtatcgccggcacaattcatgaaactggccatagcatttaaactggcgatccgccagaacaaatcttctgccacgcagcagcgccacatcgacgcgctgctgccttgcgagcggatcgccctgcggcgccacagcgtacatcggacgggacagcagcggcacacaggcaaaccgcttttgatcgaccggctcaagtgtgacgccaaaatcgattgcaccggaggcgacctgctcctcgcaggaaaaatcggtcgtctctgtcagctccagctcacacgggcgcaaagcgcgccggagctgctcaagctcaaccgcctggatcgcgagcggcacgcccatcgtcataccaagccgaatgttgtgccgttcatcgcgcagacgctccatatgatcccgcatacgggcgtaaatgccctgcatctcctgcgcgtagcgtacaaacacctctccgcttggtgtaagcgccagcgttttgcggccgcgttcaaacagcggagcgccaatttcattttccatgcggcgaatggccttgctcagcccctgctgtgtaatgaacagcttgtccgcggcagcggaaaaggttttttctccacataatgtcaaaaaatatgtgatatcctgaaagttcatatggttcgactctcgggttcctttccatgcatttatattataatagtataacagatcatacgcactttcacaactcatagtttcataactagaataaaagtttcttttcagacatgctttttcatggtatattaataaagagtttacaggcgcatacagatgtcctcggccgctttatgcctttaaatcccgtatgtgcggacgaagggcctcttacgtttatggaaaggattttgcaccatgaggaaattgattgcattcatgacagccgccatgatggccttgtctctggcggcctgcggaggttcaggcggctctggggacgcggcgtccggagcaggcgggggcgtctcgtccggagcgggcggcgaaattttattcggcgtccccgccgatgtctcctcgctcgacccgcagacgcagaacgacagttacagcgaggaagtcgtcaaaatggtatacaacacgctgtatgtctttgacgaaaacaatacccccgtcccaagtctggctgaaagctatgaggtcagcgaggacaaccttagctggacgttccatctgcgcacagacgttaaattccacaacggcaagacgctcaccgccaaggatgtcgaggcttccttcaaccgcgcgctgccggaggattccggctatatcacgacctcgatgatctcgccgattgagagcgtgaccgccgccgacgacgccaccgtcgtcatcaagaccaaggagccttacggaccgatgctcagtctgctgtgcaactataacacagcgatcatggattctgattttatcgagcagtacggccgcgatctgggaacaacggccgaaacagtcaacggcacaggaccctacaaggtggcgagctgggccaaggacgaggaggtcgtcatcgaagccaaccccgattatttcggcaataaggctcaggtcggcgccatccattatctggtcatcccggagtcgtcctcgcgtatcattgcgcttgaaaacggcgaggtcgacatgatccacaaggtcccgtccgaggaggtcgcgcgccttgaaacactcgagggcattaccgtgctcaagcagcccggcgtcggccagcgtctgttccgcttcggctgcaacgatgaaatcatgtccaacaccaaggtgcgccaggctctgaactacgctgtcgaccgcgacgccatccgcaaggcgctctttgccgacgtctccgaggagacgaccgggccgttggcgcccgccgtgttcggcagccacgattacggtccgatcaaacaggatcttgaaaaggcaaaggccctgctggccgaggccggttatccgaacggctttgatacaaaaattgtcaccaccacccagtatgacaaaggctccgagcttgcggagatgatcgccgcacagcttgcggaaatcggcgtcaacgcgacgatcgaagtgctcgaatggagcgtgttccgtccgatgatcagcggtatgacagccgaggaatttgacgcgccgctctttatcatgggcgcgggcacctcgatggcagatgccgacggcggctaccgcggcctttacaccaccacgcccgacggcaaaaacgaccgcaactacggcttctattccaatgccgaggtcgacgaatatatcgaacagggcatgacggaaaccgatcctgaaaagcgcaaggagatttacgccaaggccggtcagattctttatctcgacgaccccgccggcatctggctttacgatcagctcaatgtattcgcctacaacagcgacaaaatcgatggcctgcgcgtcgacgcgctcggctgtgtcctgtttgacaacgcgactgtcaaataaccaaaaggcggacgtttttcgtatgggcaggggacggtcccctgcccatactttattatctgccttccaaaaaatgaaaggtccccacggggctttcccatacatttgatatcagaaaaggagtcaaagccatgtctacatatatgcatatcgacgttactgatacaaccgcaaccaaggaaaccgagattcagttcaaccgctccaagctgcctgtttccgacgaggtgcgcgcaatcgaccgcgagctggaagccgatccttccaactgtgaattatggatgcgccgcggcattgcgctgtccaagcagatgctttttaaggaggccgtggaatcgtattccaagggactcagcttcaacccgtttcacgctcttacctaccgccaccgcggccaccgctacctgtccatccgctgttttgaggaggcggctgcggactttgcgctgtcggcgcgtctggacgacaccaactgggacacctggtatcacctggggctttcctattacctgctcggcgactataagcgcgcggccggggcgtaccgcacctgcctggaaaagagcgacacctccgacaaagtcgtcgcggttgtcgactggtactggatgaccgccaaacgcctgggcgacgagcggcttgccgaggcgctgctcaagcgtgtcgacgaaaacaccgatcccggcgaaaacctctcctacaagcgccgtatcctgatgtacaagggactgatcaagccggaggagctgatgcagttcgagggcgccgagtttccggatctggagatcgccacgcaagggtatggcctgtcgaattattactatgtcaacggcgaaacggataagagcaacgccgtgctcaagcaagttctgaccatcaagagcttttggagcgcattcggctttttggccgcgcttgtcgacgcgaaaacacgcggactcgattacgagatcgtcgggtcactttaaccggaaaagagggagcgtcccgtgcttggttacaccatcaaacgaattttgcaggtcatcccagtcctgctgatcatttcctttatctgctttatgatgattcgccttgtgcccggcgacccggtggcgaacatgctcggcgtcaacgcctccaaggaggcgattgcggcgcagcgcgcggagcttgggctggacaagccgcttttgacacagtacggcgattttctcgtcaaggcgctgcagggcgacctcggcaaatcgatcaccacgcgccgtccggtcatcgacgagatcgcgcagcgttaccccgccacgctgaagctggcgctcggcgcgaccgtctttgccgccgtggtcggcataacattcggcgttctgtcggccgtcaaacagaacaagctgaccgacaacgtcatcatggttttttcgctgctctccgtgtcgacgccgtcgtttttcctcgcgcttgtcatgatgcttctgttctccatacatttgggctggctgcccagcatggggctgcgcacgccgcttcattacgtgctgccgatcatcacgcttgggatgcagtcggtcggtctgatcgcgcgcacgacacgctcgtccatgctggaggtgctgcggcaggattatatccgcacctcgcgttcgcgcggcatttcgcaggctgtcatcgtcatgcgccacgcctttaaaaacgcgctgatcccggttgtcacggtggtgggcctgcgcttcggcggcctgctggccggttccatgcttgtcgaggctgtgttctccgtgccgggcatcgggcgtttcatggtcgacggcgtgctcaagcgcgactatcccgtcgtgcagggcacggtgcttgtattggccaccacattcgtccttgtaaacctggcggtcgatctgatctatgccctgatcgatccgcgcatcaaatacgattaggagggaaggcgcgtgtttaaaaacccggtgttccggcgctttatcaaacggcccgcctccgtcatcggcggcattgttctgatcatctttttcctgacggccctgttcggaccactgctgtgcaggaccgatcccaacgccatcaacccggacatctgctaccaggcgccgagcgccgcgcacatcttcggcaccgacaacctcggccgcgatgtgttcgcgcgcattgtctacggcgcgcgcgtgtcgcttggcgtgtcgctctgcggtgtgctcatcggcgctttcttcggcatcctgctcggcgcgatggccggttatttcggcaagtggatcgatacggtcatctcgcgcgccatcgacatcctgctcgcctttccggggctgcttttagccatcgtggtcgtagcggtgctcggcagcggaatgcagaacgtcatcatcgcgatcgcgttttattccgttccgatcagcgcgcgccttgtgcgcggcgtcgtcataacgatccgcaacagcgaatactgccaggcctgccgtgtgttcggcgcgtcgcacgcgcgcatcatcgctacgcacatcatcccgaacgcgatgtcgcagattatcgtcaacaccacgatggatcttggcacagcgatcctgaccgcttcgtcgctgtcgtttctggggcttggcgtccagcctcccaatcccgagtggggcgccatgctctccacagcccgcgacgtcatccgcagcgcgccgtttgccgctctgattcccggcgtcatgatcacccttgtggttttgagcttcagcctcgtgggcgacggcctgcgcgacgcgctcgacccgaaattgaaaaacagttgaggagggtccggccatggcagaacctatcttagaggtcaagggcctgaaaacatatttttataccgaggagggcgtactgcccggtgtcgacgggcttgacttcacgctcgaacagggcaaggtgcttgcaatcgtcggcgaatccggctgcggaaaaagcgtcacgtcactgtcgatcctgcgcatcgttcagtcgccgcccggacgcatcatcgccggggaaatcctttataacggcaaagacctgttaaagctcagtgagcgcgacatgcgcaaaatccgcggaaacgacatctcaatgatcttccaggagccgatgacctccttaaacccggtgttcaccgtcggccagcagattatggaaagcctgacgctgcaccagggcatgacgaaaaagcaggcgcgcgcacgcgccgttgagatgctcacgctcgtgggcatcccgacgccggagcgcatcgtcgacgaatatccgcaccagctctccggcggtatgcgccagcgcgtcatgatcgcgatggcgcttgcgtgcaacccgaaaatcctgatcgccgacgaaccgaccactgcgctcgacgtgacgatccaggcgcagattctgcgtctgatcgcccagctcaaggaccgtatgggcgcgtcggttatcctgatcacgcacgaccttggcgttgtggcggagatcgccaacgatgttatggtcatgtacgccggcgaggccgtcgaatacggcggcgtgcacgagctgttcaaaaatcccctgcacccgtatacagagggacttttgcgcagcgtgcccgtcatggggcggcgcgtcgacgcgctttacaacattcccggcacggtcccaagccccaaggattatccggcgggctgccggttctcgccgcgctgcgcccacagcgccgaccgctgccgcacggagcgcccgccgctgtatgaaatgccggacggccgccgggcgcggtgctttttgtgcgaggaaggaggcaaacgccttgactgatgagaaaaaaccgctgcttgcagtaagggacctgaaggtgtattatccaatcaaggtccgctctcgcgggatattttcccagaaaaagcttgtgcgtgctgttgacggcatctccttcgacgtgtatgagggagagacgctcggcattgtgggcgaatcgggctgcggcaaatcgacgaccggcaaaacgattgtccgcctcaaccgcccgaccgccggcagcgtgacgtacgacgggatggacctcttttcctgtccgccccaggcgcaggcgcgcatcagccgggaaatacagattgtgttccaggacccgtattccagccttgacccgcgcttcacggtcgggcgctccatcgccgaaccgctcgtcgttcacaaggcgggcgcgccggccgagcgccgcgcccgcgtcgttgagctgatgcgcgccgtcggcctgcgcgaggatgtttacgaccgttatccgcatgaattttcgggcggccagcgccagcgcgtcggcgttgcgcgcgcgctcgcgctcaacccgaagctgctcgtctgcgacgagcctgtttccgcgctcgacgtgtccattcaggcgcagattctcaacctgatgcagcagcttcaagcgcagttcggcctgacctatatctttatttcccacaacctgagcgttgtcgagcatgtgtgtaaccgcatccttgtgatgtacctcgggcatatcgtggagacagccggcacggaggagctgtttaaaaatccgctgcatccgtacacgcgtgcgctcatggacgccgtccctatccccgacccggagcttcacaaggatcgcgagccgctcggcggcgacgttcccagcccggtgaacccgccgcccggctgccccttctgcacgcgctgtccaaaggtgatggacgtctgccgccagcagcgtccgcagccagccgatctcggcggccatattgtaagctgccacctctatcagagccaagcgccctatcaaaaataagcctgaccgtcattcggtctgagaaaggaagacatccatgcaaacctccatgatgctggaattcccagttgatgaatatgaagccagaatcgccaagctgatcgccggtatgcagaaatacggatttgacgccgtgctgctctcctccaaggagaatacgcgttatttttcgggcttgcagtcgatcgtctgggacagcaagatcgcggtgccgggcctgttggtcgtgacggccaacggcgatatgacgattgtcagctccacaagcaaccagccgaccgtcaaggtgacgtcgtgtctcgagccggaccgcctgctcgcctatacgcgcacaaaggagcctggtttcccggacacgttccccaaggcaatcgcctacgcgcttgaaaaattcaaggtcagcggcgggcgcatcggcatggagatcggcacgggtttccgcgtcagcatgtcatatgccgatcagaaagctctgttctcgctgatcccggacgccgagatcgccgacgccgcacagcttttatgggagatccgccgcgtcaaatcgccgcgcgagatcgaagtcatgcgcgaggtctgccggatcaacgtcgcatcctacaagaaaggctttgagagcatcgtctgcggcaaaacgaccgaggaggagctttaccgcatcatgtgcgccgaaagctttctgcagggggcggaaaacatcctgccgcttggcatccgctgcgggcgcgagcggtactcccagggcaactgcccgccttcgagccgcgtgatcggcaaagaacccggcgaaatgatgctcgtcgacggcggcccgtgctacaagggctattactccgacatcatccgccaggcagtttcaggcaagccgaccgatcgccagcagatgatgtatgatatcgctgtcgagggcaacaaccttggcctttccgttatcaaggcgggcatcccggccagcgaggtctgccgcattgtcgacggctttttctcctcaaagggtatggacccctacaaccgctgcaagggctggatgggccacggcgtgggcctcgatgtgcatgagctgccgacgctgtcgatggactgcgacgtcatcctggagccgggcatggtcatggcgcttgagcctgagctttttgacgctgaaatcggcgtattcggcattgaacagaactttgtcgtcaccgaaacgggctgcgagcttctcacgccagcgccgcaggagttaatgcgcctgccgatgtaagaatatatatgatgaatcgacggccgccgcaatccggcggcatgggaggaacgtcaaatgattgaacaaaaaagaatcggatttatcggcggcggccagatgggcgaagcgattttcagcggcgtcctggcaagcggcctggtcaagcctgagcaggtttccgtcaccgatgtcagcgctgaacgcctcgatacactggggaaaaaatacggcgttttcactgccgtcaacgacggcgcgaacagcggcgcgcgcgtggtgatcgaacgcagcgatatcgtcgtgttcgcaatcaaaccccagtatgcccgcccgatgctcacggcggtcagcggcgcgttttcgcctgcacagctcgttatttccatcatgggcggcatcacgctcggttttctggaggaatttttcccgcaaaaccctgtccttcgcgtcatgccgaatacgccgatgcttgtgcggcgcggcatcgccggcatcgccgccggcgcgcacgcctcagaggcggacagcgcgcttggcgtcgagctgtttaacctggtcggcatgtcgtacctgctgccggaaaacctgatcgacccgctgacaagcgtaagcggatgcagccccgcgtttgcgtatctgttcatcgaggcgatggcggacggcggcgttgaaaagggcctgccgcgcgacatggccatccgccttgccgcgcaggcgctggccggctcggctgagatggtgctccagaccggcaagcacccggccgagttaaaggacagcgtctgttcgccagcgggcagcacgattgtcggcgtgcatgcgctcgagcgcggggcgttccgtaatacggtcatgaacgccgtcaccgaaagctgcgacaagatgatcgaggtcggcaaaaaggcttaggccggcgaccggcccgacacccagtccccgggacccctccgggtcccggggatttctgcgcggcggcgcatggccgccgcgccatccttcgtccgggaggaaccgttttgaaacagaaaatgctttttcaggctgtcctgccatggatcgcttattttaatatctgttttttctgggggacttcgaccgtggcgaataagcttgggtctacctccatgcatccgctgatggtgggcgccgtccgcttcaccgtcacaacgcttctgatcgctctggcggcggctgcgcgcggtgttcctctgcgtatcacccgccgcgactggaaaacgctcggcaccggcagctttctgatgtactttctcaacacgctgctggttctgttcgccgccgtacgcgtcgatgcgagcatttcgaccattgtgctctgtctgattcctgtggggcttgtccttgtcgattcgctcgcccagcgtcattttgacgttggaccgcccggtgtcatcggtatggcgggcggctttgccggcgtcgtgatcgcgtcggccagcgggctgctcggcggcggcgcggatatcggcggcatcactctgctgcttgcttcggtctgtgtatggagcgtgggcaccatctacctgaaaaaccgcacggtggaagcgcccttcatcctccagatttttgtccagtcagccgtaccggccgcggctttcctgctgaccgccttgttcaccggaaccctgcgcccctccacgctgaatctgggcggcgtgctgccggctgtttatatgggcgtggccgattccatcattgggcttggctcctacatgtacctgctcaaacggtggcccacatcggtcgtttccacttacgcatatatcaatccgattgtcgggctgatgatgagccatcttgtactgcatgaatctatgaatgcacagaaaatggtcggcgcagccgtgatcctgttttccgtgctcctcatccgtgaggacggccgcctgacagcctggctgcgggcgcgccgccgcgcaaaagctggctgaccggatcccatatccggcggccacgctggaaatttccttcacaagtttttcaccaaacgctttgtgaattgccatcgctgacgaatatatataacagaagcatttatcagacagcgttgaaggaggattttcaatggcgttgccggtgatcggatccgtgttccagtccattcggatgatgggactcagtatgaagtggcagcagcgcaaggccgaccccacaatgcccagggaaggcgaggaccctcaggccgccatgctgcgcaaacaggcgagcgacacgcgtaaaagcaacgctatcgcatcgatccaaagcaagctcgattccggcggggaattgacgcctgaggagttggagtatctgcgcatcaacgcccccacgctctacgaggaggccatgcagatcaagcgcgagcgcgcgcagtataagcagcagctcgccaactgcaagaccagggaggaggccgatcagctctacatcaacaagatgcagggctatttgagcgcggcacgcacaatctccagcaaccccaatctgtcggtagctgaaaaaaagggccagcttgaacggattgcccgccgcatgatcggtattcagaccgaacagaagatctttatcaaaaacggcgattatgaacgtctgccgagtgaacaggagatcatagacgaaaagcgcgccgataccgccgaaaaaagcggggagcttaccggtgcgcaggaatccggcagggagcaggacagcgagcgcacgcaggaagggaccgatacggctccagaatgtggcggcgatcgtccgcagagcgggacggacgctgaagaaaggcaggacgcggccgttcaaacgggacggagcgcgcatgagctggagcgcgcgctttatcgggagcttggcgtcagccggccgggcgatggagcgcgcatctatgatgcgaaaggcgtcgtgcgtgaattggattttacattcaaacgcaggacacgaaagcgtccttaaatacgcaaaagctgggtcggacacatctgtgtccggcccagctttttatgttccggcagcgccggcgcggccctctaaaaggcgatgatcacgccgccgctgttgacatacatggagctgagtccgcctgtgggcacgacgaccacgtctcgaaatgggtaacgccgccttgcctcggcggcgacgaaggcagcctggcgctcgttatggcagtgggaaacgaccagcgtgcgctttgacaggtcggcgctgcattccccgatgatatcaaccaaacgcgtaaaagcgcgtacagagccgcgcgccttttcatacagcttgatttctccatgatcggctgtcataatcggccgcagagacatcgccgaggcgacgtaaccggttatacgccccatacgcccggatttgatcagcgtgtcaaggctttccgctataaagaatgtgcgcatcccgcggatgaacgcttctgtttttgaaacgatctcgtcaaagccaagccccgcctgcacatactccgcaatgcgcagggaaaccgccagctcgccggccgacgccgaacaggaatcaaatacatggattttctgattggggcgcgcggcaagcgcgagtgtgcggccgatttgggcgctgttataagaaccgctgagttttgaggagatggtgacggcaaacacatcgccctcaccggaaaacagccgcgcatagcagtccggcgatgggcaggccgatttcggcgcgctgcggctcgccttcatcgcagcaagaaagcggtcgcggtcaagggtctcatcgtccgtgtagctgacgccgtcaagcagcatggtcagcggcgcctgtgcggcatgcagacgcgttttcagtgcgggaaccagctcgcagcagctatcagttaccaatctgtaaaatgccatagttacttcctttcccgggcggaccggccgcaccgtttggctttctccatcatactttattttgtccgtgaaatcaacgttcatttcatttccggcgtgccgccgcgttttcttgacaaattacgcgtgcaagggtatcattgaaaccggaatttttatttgaaaatgaatcggttaagacaagattcgcagatagacgggggcgatttttttgacgcttgacaaactgcccattgggcacagcggcaccatcctgacggtgggcggggccggcgcgctgcggcggcggctgctcgatatgggtctgacgccgaaaacgcgcgttatggtgcgcaaggtcgcgccgatgggcgatccgattgagctgcatctgcgcggctatgaattgacgttgcgcctggaggatgcgcgcgaaatcgaaatcgaggaggacacctccaaatgatattcgcattggcgggcaaccagaactgcggcaagacgacgctctttaaccagttgaccggctccaaccagcatgtcggcaacttcccgggcgtgacggtggagcgcaaggacggcgagatccgcgggcggcgcggcgtaacggtcgtcgacctgccgggcatctattcgctctccccctatacgagcgaagaaatcgtcacgcgggattttctgctcaaccagcacccggacggcatcatcaatatcgtggacgctacaaatatcgagcgcaatttctatctgagcatgcagcttatcgagctgaatattcccatggtcgtggcgcttaatatgatggatgagttccgcgccaacggcggcaccatcaagctcagacgcctgtcggaggagctgggcgtgccggtcgtgccgatctccgccgtcaaaaacgaagggatcgacgagctgatcgaaacggccatcgccacggcgcgcgaccgccgccgcccggcacgcctcgacttctgttccggcgcagtgcaccgcgcaatccacgcgatcgcgcacctggtcgaggaccatgcggagcgaatcggggtgccgccgcgtttcgccgcgacaaagcttgttgaaggcgacctgccgatgcttgagcggctggagctttcacagaatgaacaggatatggtcgagcacagcgtcacggaaatggaaacggagcttggcaccgaccgcgaggcggcgctcgccgatatgcgttacagcttcatcgacagtctgtgcgcccaaacggtcgttaagcctacggaaagccgcgagcatctgcgcagcctgcgcatggataatgtgctgacgcacaaatatcttgccatcccgatttttctcataatcatgcttgtgatcttctggctgacgttcggcgtcatcggcacggctctctcggacttgttgtcaatggggattgacgcgctcacggccgcagcgtcggacgctctgacgcgctacggactcaatccggtcatccattcgctcgtgatcgacggcatattcgcaggcgtcggcagcgtgctttcctttctgccgatcatcgtcgttctgtttttctttctctcgatccttgaggacagcggctacatggcgcgcgtcgcctttgtcatggacaagctgctgcgtaaaatcggtttgtcgggccgttcgttcgtgccgatgctgatcggcttcggctgttcggtgccggccattatggcaacgcgcacgctttcctctgaacgcgaccacaagatgacggttttgcttacgccgtttatgtcgtgcagcgccaagctgccgatctatgccatgttcaccgccgctttctttccggagcatccggcgcttgtgatgatctgcctgtacgcgggcggcatggccgtgggcgttctgtgcgggcttgtgctgaaaaatacggccttccacggtaagcctgtgccgtttgtcatggagctgcccaactaccgtctgcccgggccgaaaaacgtcgcgctgctcttatgggataaagcgaaggattttctcacacgcgcgtttacggtcatttttctggcgacaatcgtcatctggttcttgcagacgtttgacacacgcctgaatgtcgttgccgcaggcggggaggcgagtatgctcgccggaatcggccggttgatcgcgccggtgttcacgccgcttggtttttccgattggcgcgcgtcgaccgccctgatcaccggcttttccgccaaggaggccgtcgtcagcactctggctgtgctcaccggcacgaacaccgcgacgctgccggcggcgctcgcgcagattttcacgcccgccgccgcggtcgcgttcttaacgttcacgcttctttatacgccgtgtgtcgctgccattgcggctgtgcgccgcgagcttggcgggcgttacgcagccgtcatggtcatggggcaatgcctgatcgcctgggcggccgcattccttatctatcacgcggcgcgtctgatcttttaaatgcgcatgtctataaaaaggcgcccctggaacctgtgttccaggggcgcctttttgttgcatccgccaatgcttcaaaaatcaaacgtctcggggtcaaagcttgtccgcccgcctgtgtccatcgcgtcgatggcgcgcatatccgcctcgtcgagcgcaaaatcaaacagatcgatgttttcaaagatgcggtcgcggtgtaccgatttagggatcactgcatagccgctctgcacattccaccgcaggatgatctgcgcgggcgttttgccataacgcgcggccatctcccggatctgcgggaaatcgaagctgccacgcacaagcggaccccatgcctcaacctgaatgccgcgctgtgtgcaccactgtgccagcccgttctggttgagcagcggatggcgttcaatctggttaactgccggcatcacgtcgcagtcctcggccatccattgcaggtgccgcttcatacaattggaaacgccgatcgcgcggatgcgtccctccttatgcagccgctcgagcgcgcgccaggattcaatcaagcgcgagcgtttctgacccggccagtggatcaggaaaagatcaagatagtctgtctttaattttctcaagctttcctcgaatgacagcagggccttgtcgtatccttggttggggttgtccagtttgcttgtcagaaagacatcgctgcgcacgatatccaggcgacgcagcgactcgcccagaatatgttcattttgatacatctgcgctgtatcaaaacttcgatacccagcttcgagcgcataccgcactgcgttgtccatctctttctggtcgttggtcttaaagacaccaagccccaccaacggcatttcaatgccattgtaaagcgaaaccacatgtctcatctaaagccgctcctctcaatgcgcctatggcgcttgataccattataaaacaacagcaaacatttgtacagaagatcaaataacggaattttttaaaattatttgtctgtttccatcgaaaaagcaaaatcgcatcgtccaccctataactaacaaacgctattttatctgatacaggcgctggctttctctctgtatggccaaataacagccatacattatggccattataacagccataatggactatgtaaaggggttgggcggcgtgatttcatacggaccgttatggaaaactatggcggaaaaaaaggcgacaacttacacattgagagaaatttacagcatcagccattcaacggtccaacggctgcaaaaaaatctgcccgtctcaacatacacgctcgaccgcctgtgcaaaattcttgattgccggctggatgaagtggcggaatatatgccggatgaagccttgtgagccacgcatgacatggtcaggcagcagccctgtgccggccgtgcttcttacctgcacaatttaaagcacaggaggcaggaccgtgatacgatatcgtcctttgtgggagactatggccagaaaaaaagcgaccacctacaccctgcgggtgatatacggcatgagtcacgcaaccgttcagcgtctacaggcaaacttgcccgtatcaacacatacgcttgacaagctgtgcaaaatttttaattgtcagattgaggaaatcgtcgagtatgttcccgacggcgagttgtaaccccccgatataatcttacccgggccgggcgcctccctttaaattaaatagctgttgaaaggcgcctgtatcctgaatcacgcctgtttatctatgggaactttctccatcgagtttcatatataaaagcggatacggatttccctgttcgtcatggtccgttctcttataaactcgaaatcccatgtgttcataaaaaccgatcgcaaggggattttgctcattaacagccaatcgatggacggaatggttttcgattccatatcgaataagcttctttcccaagccctttccccttgcttcggaagcgataaacagcatttccaaagtttgttcctccactcccatgaaggcaaccggtcctttgctttcgctttctgcaacaatcaggcagtcaattcccttgagcgcctgcggaacaaatttttttattttctctatttcacagcccgataaaaacagatgcgtcgcctttacagaactttcccatacttttgtaagctgttctatcagcaagggcgttctctctttcacttcaataagtttcatttttcttttacctttccgtttaatgaatcattttgattgtgaaaataaatatagcatacaagtatatagaaatccaccattcccttcaggcattgccgcgccgcgtatggaagggggtatttttattttgcatcgttttgcgtatccttttcctgcgccgcctctggaaatggcgttctgaccgccgccggccctgcatatactgccatagacagtaattgcaggggaggtttccgtcttgaaaggtctgccggaggaacgtgccatcacgttcgcgcactacatcattgaacacaatacaaccgtccgtgctaccgcgaaggaatttcatatatcaaagtcgaccgtacataaagacgtcacagagcgtttaaagcgcattaatccgctcgtttacgcacaggttaagcaagtgctcgaccacaataaatccgaacgtcacatccgcggcggaattgcaaccagggaaaaatatgcgcgtatgaaagcgcatggataagtttaaaaccaaagtggggtatggcgtgcgctatgccccactttgaaactaaataacgtttgtttcggcaagacgcacaagaaatcgctgacaaaattgtacaaaaatcaattaaattccttgggtttttcggttgacattatttgcctgcccgtttataatagttaacagaaagttcataaaccatttgggttgttactggtaatgcaggcaaaaccaaattttgcatggctgagagggactgtgcgaaatttggtttttttgtattttgcggggtatttatggatgaaaattttaaaggcgatcaacaataatattgtcagcgcgcgcgatgaaaacggcaaggagattgtcgttatggggcgcggcatcggctttaaatgccgtgagggcgacagcatcccgccggaagcgatagagaaaatctttcacatggacacgcaaaatgaaaccgaccgtctcaagcagcttttttcctccatgccgcttgaacatatcgaggtcacaaaccgaatcatcgcctatgcccgcaagatcttgggcaagcggctcaatcacagcatctacattacgctgaccgaccacatcagcttttcggtcctgcggttcaggcaaaatatgatgtttcacaacgccctgctggcggaaatgaggcggttttatccacaggaatattccatcggccagtatgcgcttgacctgatcgccaaggagcttggcgtccgttttccggacgacgaggccgcgtcgatcgccatgcacatcgtcaacgcggaatacgacatatcgcttggagaagctgtcgacatcacgcacctgattgaccagatgctccggatcgtgcgcgattggcacagacgcccgctggacgagacttccgttgattttgaccggtttgtcacacatctgaaattcctggcgcagcgcgcgctgcgccaggatcgcccgccggcgggcgaccgggcgctctatgacgccatcgccgcgctctatcccggcgaaaccgcctgcgcgcaccgcgtcggcgcttatctgggcgacacgcattcatttttgatcggcgatctggaggcggcctgtttggcgatccatatccggcgtgtgacagcgccggacgcgtaacgcgctttttcagcacaattcggcgtgctgctgtgctatgatattggttgcggtatatggcttgtccattttcagcgtccagtatcttttgaggaaaacggcgcagactatactgcactgcgcgctagataaaagcgacaaagatgcgcggcatccgccgtgcaaacgagaaggttgtgacaatatgtttggaaagcttaaaaatatgttcggcgcaaaggatgcagccgtcatgattctcgcgcctgttgaaggggaggtcgttccggtcacgcaggtcagcgatcccaccttcggcgaggagattctcggcaagggggtggcgatcaagccggagcgcggccgcgtcgttgcaccggtgagcggcgagatttccctgatgtttgacaccggccatgctgtcagcatcgtttcggatgacggcgccgaggtgcttgtacacgtcggacttgatactgtgagcctcaaggggcagttttacacggcgcatgtcaagaccggcgaccgcgtcaagacgggcgatctgctgattgaattcgacatggatggaatcagcggggcaggctatcaggttatcacgcccgtcgtcgtctgcaactccgccgacttttcccaaattgaaacctttacaggcaagcacgccggcgaattggaggagctgatccgcctgcgcaaataatgaacggcaacccatctgcggatggagggagtgatttatcttgttcaaaggccatggaagaagcgtcttttccggcgtcgcaatcggaccggtctacgcgtttgaacgcgtgagcgccccagcgcgccacgtcccggtgcttgacgaggcgacggagctgtcacgctttcacaccgcaaaggagacggcagcttcacagcttcgcgcgctgtatgaaaagacgcggcgcgaaatcggtgaggacgaggcgatgatcatcgacgtacagatgatgatgctcgacgacggcgactacaacgacgccgtcgaggagggtatccgcggcgggtcgggcgccgacgcagccgtcgcggccgccggccggcagttttcagagtttttcgcctcgctcgacgacccgtacatgaaggcgcgcgcggccgacgtgcgcgacgtatcgcagcgcctgtccgacatcctgtgcggccgcgagggcgtgccggcgctcaccgagccgatggtgcttgtggcggacgatttgacgccgagcgaaacggttgcgctcgataaaaacaacatccttgcgtttgtcacgcggcaaggctcggccaactcacatacggcgattctcgcccgcattatgaacatcccctcgcttgtgcaggctgacgtgccgtccggggagaagctgcatgggcgcatgattgcggtagacggcttcacaggggagtattttctcgatccggacgaggcgaccgtggcgcgcctgcgtgaaaaacggcgcgcggacaccgagcagcggcgcgcgctcgacgcggtgcgcggactgccctctgtaacaaagtctggcaggcaggtgcgcctttacgcgaacattggcggacctgaggatgtccctgccgtgctctttaatgacgccgagggcgtggggctgttccgcagcgagtttctttatctgggccgcgacgactatccgagcgaggacgaacagttcgaggcataccgcaaggctgccgagcagatgggcggcaagcctgtcatcatccgcacgctcgacatcggcgcggataagaaggccgattactttggcctggcgcgtgaggaaaaccccgcgctcggctttagggcgatccgtatctgcctggagcggccggagctgttcaagacacagcttcgcgcgatctaccgcgcgtccgcttacggcaaggtagcagtcatgttcccgatgattatctcagccgacgagacgaaacgtgccctggcgctggccgccgaagcgcgcgccgagctggccgcgcggggaatcgtggtcgacgagattgaacgcggcgtcatgatcgaaacgcctgccgccgtcatggtcagcgccgagcttgcaaagcttgtcgattttttcagcgtcggcaccaacgacctgactcagtatacgcttgcaatcgaccgtcagaacgagcagcttgacaaattttatgatccgcatcatccggctgtgctggaaatgctgcgcgtcatcgcgcaaaacgcccatgccgccggcatctgggcgggcatctgcggcgaactggcagcggacgcggaattgacggacacgttcctgaaaatgggctacgacgagctttccgtatcgccgccgttcattttggagctgcgcaaacgcatccgcgacagcgcggtataaaaacttcggacgttttaaaaggaggggtttcccatgcgtgaaatcaagtatacgattacagacgaactgggcatccacgcccggccggcaggacagcttgtcaagcaggcgtccgccttcaaatgcgacatcaaagccgcttcgcccgcaaaatcggtcgacgccaagcgcatcatgggcgtgatggggcttgcgatcaaaaagggcgatgtgctgaccatgaccttcgacggcccggacgaggacgcggccgccgccgcgctcgaggcgtttttaaaggaaaatctttgatctttccctgccgtccatgctgcgggcggtttggagcatgacaactggggaatgccggttccctgtgggaccggttctcatagacagcaatcacaaaaggagggtatctgttatgatgaagtatttacagaagctcggcaaatccctgatgctgccggtcgcctgtctgccggcagccggtatcctgatgggcatcggctactggatcagtccgtcagttatgtcgggcgtcggcgacccgaacgtgttcgcgttcttcctggtcaaagcgggcggcgcgatcatcgacaacatggcgatcctgttcgccatcggcgttgcgctcggtatggccgacgaccgcgacggtacatcggcgctcgccggtatcgtttcctggctgatgacgcagcttttgctgtcgcccgccgttgtgtcggtcctgaccggcgcggaggcgaacgcggctttcggcaagatcaacaaccagtttattggtatcatcagcggtttaatcggcgccacctgctacaataggttcaagaacaccaagctgcccgacgcgctcggctttttcagcggcaagcgcagcgtggccatcgtggccgcgcttgtcacaatcgtcgtggacctgatcctgttctttatctggccgatcgtttacacaggccttgtctcgttcggcgagtggattctcagcaccggcccgatcggcgtaggcatctatgcgttcttcaaccgtctgctgatccccgtgggtctgcatcacgcgcttaactccgtgttctggttcgacgtggccaatatcgccgatatcgcgcgtttctggggcaccaaccccgacctgccgggcacactcggcgtcacgggccagtatatggtcggcttcttcccggtcatgatgttcggcctgccagccgccgcgcttgctatgtaccacacatccaagccgcagaagaaaaagctcgcctacggccttctgatctccgccgcgttctgcgcgttcttcacaggcgttaccgagccgcttgagttctcattcatgttcctggctccgggactttatgtcgtgcacgcgctgctgaccggcgtttctgccgctgtctgcgccgtgctgccagtgcgcgctggctttaacttcagcgccggctttgtcgactggttcctcagcttcaaggctccgatggcgctcaatccgtggctcattatcccgatcggccttgtgttcgccgtcctctactacctgctgttccgggtcatcatcgtcaaattcaacctcaaaacgcccggccgtgaggatgacgacgatatcgaagcggaaaagaaaattaccatttccaacgccaattttgccgccgttgcggcgggcattcttgaaggcctcggcggtaaggacaacattacctccgtcgataactgcatcacccgcctgcgccttgagatcaaaaattatgaacttgtcaacgataagaagattaaggctgccggcgccgcgggcgttatgcgtccgagcaagacgagcgttcaggtcattatcggcacccaggtccagtttgtggccgatgaatttaaaaagctgctttaagctgctctgagggcagcggccgaaccggtggggacgggcggaaatccgcccgtccccaccttgcatcagcgaatacaaaggagggctttgctgtggaatatcaggtccacaccatcggtacgcgcgccgaattgccggcttgccccgtctttctgatcgaccatttccagtggacctgccggcggcggccggcggcctgggggcgcatgggatatctgcgggacacagggctttgcgtggagcttgtctgcgaggagcgcgatccgctgcgcgtttatcacaacccgcaggaccccgtctgccgcgacagcgcgctcgaagcgtttttcgcctttggggatctgccgggggagcctgtgcgtaacgacggcttttactgcaactttgaactgaacgccaacggcgcgatgtatgcaaagcttgggcgcggacgcaaaaaccgccgtccgctcaccccggaggaatacgcgctctgcgcgccgcgcgcacagcttggcgcgcaaagctggtccgtggagctgaccgtgccggaggcgctgctcgcttcccaattggggcgcgcgccattttcgcccggcgggcagttcttctgcaatttttataaaatttcagagtcgcccgacattgagcattacgccagcttttcgccggtcgacagcgaaaagccgaactttcatttgccggaatgctttgcgcgcgccgtgcttatctgaagggcttttattttgccgcacgcactgctataatgaaatcaaaccggttctgctgacaagaccgccctaaaaagaggcggcgttatatttgtcgggcagccctgaatccgcgagaggtgatagatatgagaatttaccgggcaaaggattatcacgacatgagccgcaaagcggcaaacatcatttcggcgcaggtcattatgaagccaaactgtgtgcttggcctggctacaggatcaagtccgatcggcgcgtataagcagctgatcgagtggtaccataaaggggacatcgatttttctgaggtgcgcaccgtcaacctcgacgaatacaagggactcagccgggataacgaccagagttactactatttcatgcacaaaaattttttcgacgccgtcaatatcccgccggaaagcatcaacattcccaacggcatggagtctgacgccgctaaggaatgcgcccggtacgacgaggtgatccgttcgctcggcggcatcgatctccagctgcttggcctgggccataacggccacatcggctttaacgagcctggggaagcgtttgaaaaggagacgcactgtgtcgcgcttaccgaaagcaccatcgaagcgaacaaacgctttttcgagcgtgaggaggatgttccccgctttgcctataccatgggaatccgttcgatcatgcaggcgcacagcatactgctggtcgtcagcgggcaggacaaggcggaaatcgtcaaaagggcctttttcggtccggtcacgccgcaggtacccgcgtccgtgctccagcttcacaaccatgtcactttggtcggcgacgaggcggccctctcgctgatctgaccgggtgcggcgccgcgtctgcgcctgacgggcgcggacacgctttgtatcctgcccgccgcaccggcgaactcttttttaccggaggtaccgctatgatcatcaaaaacgcgcaggtctttaccgaggacgccgtgttcgtccaaaaggacatcctgattgaagatggcgtctttacagaacaggccggaggccaaacgatcgacgctgccggttgctacgccatccccggcttggtcgacatccattttcatggatgcgtcggttatgatttctgcgacggcacacatgaggcgatcaccgccatcgcgcgttatcaggcgaaaaacggcgttacggccatctgtcccgcaaccatgacgctgcctgaacctatgctcgaaaccgtctgccgcgccgccgcgtcctggaagcccgggccggactgcgcggcgctcgtcggcatcaatatggagggaccgtttgtctcgcttgaaaaatgcggcgcgcagaatcccgcctatatccacgcgcccgacgcggacatgttccggcgcctgcaacaggcttccggcgggctgatccgccttctggccgtcgcgcccgaaacggacggcgcgctcgatatgatccgtgcgcttgacggcgaggtgctctgctccatcgcgcacaccacggccggctatgatcttgccgccgaagctatcgccgcaggcgcgcgccatatcacgcacctttataacgccatgccgccgctttcgcaccgcgcgcccggcgtcatcggcgcggcgtccgacgcacaggactgcgaggccgagctgattgccgacggcgtgcatatccatccgtcggcagttcgcgccgcgttccgcctgttcggaaacggcggccggatcatcctgatcagcgacagcatgatggctacggggctttctgacggcgattattcgctcggcggacaggctgtcaaggtcgtcggcaaccgcgccacgcttgagagcggcacgatcgccggttcggcgacaaacctcatggactgtatgcgcaccgctgtgcgcgacatgcacatcccgctggagacggccgtaaaatgcgcgaccgccaatcccgcgcgctcaatcggcgtctatgaccgccacggcagcattgcgccgggcaaggctgcaaacgtcgtcctgctcgatgataagctcgagatccaatcaattgtcttaaatggcgcggtgctttgacaggttgcaaaaaagccgccccggtccgcatttttgcggaccggggcggcttttcattgaccggccatcagtcaatacgatcgcgccgcgccatctgcacggcagcctgtccggccaaaataccggtattccatgcccaatgcagattatatccgccgcagttgcccgccgcatcaagcagctcgcctgttaaaaacaagcccctgcggcggcgcgacatacaggtttcggggtcgatttccgaaagcggcacgccgccgccggtcgtctgcgcctgctcccaggagagcggacctgtcacctcgaacgtccagcccttgagcgcgcggacgagcgcggcggtctgcgtggcatccactccggcaaccggacgcgacagcggcgcaaggccaaccgatttcataacggcatagccgacccgcttcgggacagtcccgagcagccattcctccagcgtttcacatatgccgcgccgcgcgtcgagaagcgccgccaggcgttccggtttccagtctgggaaaaaatcgatctgaatttcatacggagcgtccagcttccacagcaggcaggagagctgcaatgcggggatgcccgaaaggccgtaatccgtgaacagccattcgcccgtctgctccccaagcctgcgccccgcacaggtcaatacgccgcgcacacggacgcgaatgcccttcaaaccgcccgcaaaggcgtttttacatttgatcggaacaaggcatggatacagcggcgtgaccgtatgccccaaatctcgggcgacctgatacaatccgcccgtaccgcccagcttcggcgcggccagaccgccgcctgccagaatgacgcatcgcgctgtcacacagcggccatccacagacagaactgcaaagtcccggccgcgcggttcaacggccgcgacatcaaacttcagcgcggtgcagacgcgccgccgccgtatggcggcaagcaggcaatcgagcaccatcgatgcctgaaagcaataaggatatatttttccatcctccggcatactgcacagcagcccaagcccctcaaaaaacgaaagcgttttttgagccggcatctgcgcaagcatctctgcaagcgcagcccgatccctggtatgataatgccgcgcgctgatttcaagatttgtcaggttgcagcgtccgtttcctgtcgcaagtatctttttgccgacgcggtccatccgctccatcaagagcacacgcgcgcccgcgccggccgccgtgacggccgccgcaagccccgacgcgcccgcgccggcaatcgccacgtcaaagcctgtttgctccttcaatcaatccaccgcctgtcttaagaccagtataccgtctttgaagcggccgcgcaagtatgcagaccttccgtgcacgccctgtatacgcacaatatttacttttaattacaaaaatgttataataaataatataaggaaatttattgtataaaaacaggccggtgggaaaggaggtatcaagcgctaacagcaatccgccatcccaaagcctttcgactgtacacgcttgtaaagaaagaaggaaaaaggaatgggtaaaaatgcattctatcctgttaacacgctgctgaatcgatgcgatgccgcgcaacccatgacaggagggatgacgatgcgcaagcttctgctgatagccctgctgtccgccgcgctggcgggctgcgggcagggagaacccgccgcgtcccaggccgacgcgtcctcccaattgcccgcagcttcatcgcaggcggcgtcggagccggttgtattagaaccggttgcgccggatgtctcaagcgccgtttccagccagccggcggcatccgcgccgccgcaggctgtcagcgccgcccccagccagtccgaaccgcccgcgccgtcaacggcttcgggcagcaaaaccccgtatatggaaaaccagatccccaatacggacggtacctatccgaacccagatgatccgaatgaggcccccgccgccgaaccggatgacagcataatggattataatcaaaaggtgtacgattttcaggattactgcgacgcgatgatggaccccgatgtatacggcggatgcgtgggtccggcaaaccgctttgacaaggttgtcaccgtgtattatctggagaattcggatccggtcagggcggtcgcggagcaatatcagccgggctgggacggcgaagacagacgttatgtcgacgaacccatacagattgtatacgaacgggcggattactccatgacatatttaaggcaggtcaggcaggagatcttcgacgagctggtccggcaggggtttggtcttccagctgacaatgaagtgtccattcgccgcaaccgggtcaacattgtgctgtatccgcccgcgtatgaagccgcgctggaatttttgaaaacatatccgcatacggattgtatcggcaatgtgacagatgcgtctgcgctgccgcccttgccaaatacataatcagacaggcttttcagcccctgtccgggggcagtaaaaagaaggcggacgcgatcgcgtccgccttctttttactgcttcgtcacaaatgagtcccggccttttgccgcatccgccgccttacggcaaggcgtacacatatgattcgactgcaatgcatcccgctaatcgcggcggcgcagatggattgcaaagccgccgacctcctcctgcaaataaacggccacgacgcccgcgccgtccatgacaagcccttcctcccggaatgcaacgccatgcgcctgataccaagccatcgcgcgttcaatatggttgaccgcaattgccaggtgcccatgcgcgcccagaaaaggtttttttaccagctcggcggctgaaccggcgaaccaggctcccggcagctccctgggcgcaaagccgaacagacggtccagcgcctttgcgcgctgttcagcttcctgcgcgccggcgcagttcatacccacatggcatagctgcgggtcgaacatcgtctgtaccgccgcgcggcaaagcgtctcgatttcgtcgaaacgcccggcctccaccagaccggccggcaccagaaagctcccaccgcagcagagcacattcggcaagctgaggtatgcattcaggttatgcaggccgacgcctccggtcggtataaaccgggcctgttgatatggcccgcccaaagcgcgaagcgctccaacgccaccgctttgctccgccggaaaaaacttcaggtctgtgaaccccatcgccaacgcctgttccacctcggtcgccgtggaaacgccaggataaagcgggatttcatggtttttgcaccaggcggcaaccgcaggtgaaaaccctggcgtcacaagaaaccgggcgccggccctgacagcggcctcggcctgatccacactgaggatcgtccccgcgccgggcagcatcccgggccgttcggatgcgatggccgcgacagcctgcgccgccgcctctgtgcggaaggtcacttcaatcacatcaattccggcggccagaagcgcgtcgcacagcggcacggcatggcgcgcgtccccgataacggcgaccggcagcatcccggcagcgtaaagccgttttgtacattcatgcattggccggttcccccttctccataaaagcggcaagctgcgcgcgcgtcggcaagccgtcgttgtctcccacactcatgacctgaatcgccccgaccgcgttgccccggcgaacggcttcgcacagaggcagcccctccaaaagcccgctgaggacgcccaccgcaaagccgtcgccggcgccgaccgtatcgaccacctgcctgacgggaaagccttgcgcccaaaacgacttttccggcgtgcaggcgtaagcgcccgcgctcccattcttgaccacaacggttttcgcgccgaggccaagataaaaggcggcgatctcctcacaggtgcgcgcccctgtcagcgtttggccctcagcgatcccgggtaggaacagatccgcccgcgcagccaaatcgttaacaaaccgtgtcatcgtctccctgtcaggccaaagctgcggacgcaggttgggatcaaaggagaaaaacatcccttcatcccgcgcgcggtccgccagcgcgagcgccgccgcgcggcagctgtccgacagggcgggcagtatccccgtcatatgcaaaacgccataacaggaaaggtccagcttttccacatcggccgcgcaaagcgtcgatgcagccgaacccttgcggaaataaaagatttccggatcgcctgcgtgcaccttcgattttagcataaatccagtggggcggccggcgcagagggccgtaagctccgtaccgatgccgttttcccgcataccgcggacgatgcgtctgccaaacgggtcgtcccccagcttcgtcagatatccggccgtatgctccaaccggcgcaggccgaccgccacattgtattcagcgccggcaattgccgccgtatagccgtccacacattccaaaggcccttcgctctgtgcgatgaacaaggccatcggttcgccggccagcaaaacgccttgtttcatatttatccccctatccgccgcattgcgcggcatagtcccagtatgcgcgatgattcacattcggttctctttgcgtcacgccttccaggggatttttacgcccacatcctccgaaagcgcctcgatcgagcctgccacatcgtccggcagttttatcccctcgcttacggcgcgcgtgtaacgttcccattcgatttcgcctggggtataaatgcgcgtggagccttgggccttgggcgccttgcgcagcgccgcggccatctgctcattttgctgcacatacgcttgcgcgccgccgaacacctcgggattgacaaccaaaaacgcgtggctcacattgtttggcttgtcaagctcgaagcaccaggagacaatttcgccgctcatactggtggcggcgttggcaagcgcgccggtcaaaaggtccaccagaatcgacagcccgtaccccttgtgggcggccatgggctgcatggcgccctcctccgggtaatggctcggatcggttgtaggcaggccgtccttgtcgacgatccagctgtccggaatctggcggccgtccttgcgcgcctgcaccaccttgagcgacgccacattgctcatagcgatatccaaaaaaatagagggggtgctctttgccggagcggcataggccagcggattgttgccaagcagcatcccctttgcgccgggcgcggtcatattcgggtccacattgctgacgcaaagccccagcatcccggctttggcggccatattggcgtaaaatccggccgcgccgaagtggttgctgcggcaaacggtcacgagcgccacgccggatttgcgcgccttttcaatggcaagctccatggccctgtaggaggcgcattcacccatgccgttttgagcgtccaaaagcgcataggccgggccgtcggtcaggaccttgagggccgcgtggatatccatcccgccggcgcggaattttttgatatagttatgcaggtttttcgtcccgtgggagtgcgtcccatatgcgtccgtctcggcaagcgcctcggcgcagcggcgcgcgtcgccgctttccatgccctcatgctccagcgcggccgtgcagaacgcctttaaatcctccagcgcgatgatatgttccatcgaatcaacctttcaaatgcttattttatggggagcatctcaatatttttgttggggcagcggttatagcacatcccgcaggcgacgcactgtgtccggtcgatggccagctgatccggtccggtcaccagcggcgcgaaatccgtgcagatggttttgcagagctggcacccttcgccgcagccgcagtttaagcagcgtcccgcctcggcaatcgcctgctctttcgatgcgatcaccggcgcgtccggactgtccccgacataaccggcgcgctttaggacctgttcggccgcaacaggcacggggcggggcgacggcttcagcacagccttttcccccataacccattgatccagcctgaccgctgcgttgtatccggacgcggcggcggcgattatgttcgcgccgccggccgtgaacacgccgtcgcccgcggcgagccggacctcctcgctttgcgccgaccatacgctgccgcacggcaggctgacgcggctgccggccgggccggacagaatcagcgccccgtcctccagcgcggcgggcttgtatccgttcaggacggtaatcccttcgccgcgcagcagggcggctttcttttcaggcatcgtcccggttggtatgacaacagcggccgccgcacctatatgcagcgcgctgcgcgcgccgtccgcggccgcctggggcggcccgatcacggcggccgtgccgcaaaggctctgctcccgcgccatatcgagaacagagcggacgccctccccgccgggcagcgccgcccaggggttgacgccggtccggcccacggctgcgcacacgcccgcaaatccatcctccagcaggcgctgcgggtcggcctgcacgccgcagcgcagctcgacgccgctgccggcaatcgtctcaagaagcgccttcaggttctccgcagggagctgtcccgccgcgacggcgtcgttgaggccgccgcccaaagcggccgcctgttcaaaaattgtgacggcatagcccgcttttctcagctcgtcggcgcaggcaagccccgcgggaccagaaccgatgacagcggcgcgccgtccgttttgcacagcctgcgcggccgtcggctgccacccctcggctctgccaagctccagcacgaaccgtttgagcgccttgatggcgacaggccgcccggtccgtccgcgcacgcaggcgtcctcgcacggatgcgggcagatataggcgcaggcgccctgcaggacgcccttgccggtaatcagctcgtaagcgtggtgaaagtcgccgcgcgcaatcgattggacgtatgcctggacggggacatggtgcggacaggccgccttgcacggcccggcaaggttcggctcccggatatgggcgtaaccgtcatgcagcgtcagctccggcgccgtcctgacggcggacaccacctttccgcagaagtcgtcgatggagcggtagccgtgcgtatccatatagtccttgagcccgcggatcatgggccggacgatatcatagccgctgatgagcgtttccgcgcagacgccgagcaggttgccgccgcacaggaccatctcgacggcggagcgccaatccgtgatgccgcccgccgccatcatcttcggctccatcccgcagaccttgcggatttcataggcgtcgcgctgcgccagcggtttcagccatgatccgcagtaacagctcatactgatctcgtcctgcaaatggtaaaccgcccggccgggatcgttcagatcgatgggcggcaggcccaggcggttgcccgtcgaaccgaccgcgtcggctcccgccgcataaagcgcggccgccacctgtgcaacctcgccgccctccggcgtgagcttgacaaacagcgggatatgtatctcctttttaatcgcgcggacgatctccgccaccacaccggcctggcggccgaggctggcccccgtctgctggctggtgctggccgcgccgcccgaggaaagcgaaacattgtacgacatattcggacagcacatattcagttcaataatatccgcgcccacggcctcaaattgtttggccatattgacccatccggcggcgccgcggtcgccggcataggtgatattggccatgaggatcaaatcgcttagcacctttttggcgtcctcaatcagcgttaagccctcctgaaaggtcaggcgcttttcagcggtaaaggccagggcgtttgtctcatcaaaaagcccgtaacgcggcttgcggttgatgtagggcgcagggtcgatggacagcttgatgctggcggccgcccatcccgtttcctcaatgcgctgaagctggcggacgttctttgtggtcggaccggaggccacataaaaggggtttttaaatgtgacgccgccgactttgacagggattctgatgtcctccaccatttacgcctcccttggatttttgatatgcctcccctcgcgggccgactggtagatcaggctgacaagctccatggcggccagcccgtcctctccgcgcaggcccgcgcgcgccggttttccggcggcgacgcagtctatgaaatgctcgatctcgctgacatagccaagatcgtatttttcatccacagcagggcgggaccatcccgttgtaagctccgccttttccacggtgtaatcaaatccagggatggaaaagccgcggatagcgctggagaacgtcagatccagatgcaggcatcccttcgtcccataaaagtcgatgttgtcctccatgccgccggtggttacataattggcttcaagctcggccgtcgtcccgtcggcaaagcgcacgagcgcgccggcccagtcctctccctccatggatttgtgcacaaggttttgctccagcccgccggaggtcagggcggtcagctcggtccagcgcccttccttcagggccagaagcaggcccacggggtggatgcccagatgaatcattgcgccgccgccgcagaaccgcagggattgggcgaacgggctgtgcgacccgcagtggcattcgcgcgcacggataaatttcacttctccgatcgcgccgcttttgaccagctccagcgccttgacaacggtggggcagcctagccagtcctcggcgtaataaatgttgcggcccgcgtcgtttgcggcctttaccatctcgcgcgcctcctgcggggtgacggccaggggcttttcactgatgacatggcggccatgccgcagcgcgcacagcgcggcgtccttatgaaggaagttcggcaggcagacatcgacaacgtcgcagtccacggctttgacggccgtctcataatcttcaaaaaaggcgcagtccgtaaagccataacgggcggcgaggtcttttgcgcgggcaatatccttatccacgatcgctgcgatctgcgccttttgccggacgcgcgcatagccgtcggcgtgcagatcggcggaaaaggctgcgccgatcaggattacttttactttttgcatctataatctccttaaaagctgctgtatccaaacggttttttgacctgcatataatcaaacgcctggtccatctcctgtacagccagagcagtgaaccgctcaaggatacgcttgcccttgtctgcggacgccctgctcggctcgccccacacgccgcttggggatgcgcgaaagatgctgccatagccgagataagggcgctggacggcgggtacaaagtcgaccgcccgctccatgtgaaccagctctggagcgatgtgcagcatcagggacgtttccacttctcccgcgtgcagctccgtgtccgtctcggtgattccctcggcggcgacaacgccgaacaggctgcaaatatcgatattgaccgccataaaatccgggttgttcgtcgcgtttacctggcggatcacggcgggcaatacgaagatgccgccgtggcattgaagcgtgaccgcgcgccggaagccctgttccttcaggctcatcagcatgctgtacagcatgtggtaaaaaacatccgggtccatccagacagcgccctttttgcccatatgctcccggcatgtgctgaccggcagcggcggaatggaaaacccgcccgcggcctccgcgaccgcttcgccgaaggccgccgcgatgcggtaatcggtggacagcggcagatgaggcccgtgctgctcgatagagccgatgggaatgatagccagatccgtatcccgcgcggctagctcgtcggcggtcctgtcaaaaagctgcatacccccctccttacagcagggacgcgctgtccgcgtcgaggtaaagccgcgcgtccgtatgcctgcgcagggcgctggcggggcatcgctcgcagacaggcccgcgcagcgcgtccgcgacggcccgcgccttgcgcgcggtcggcacgacggcgatcgcatgcgggatggccagaatctggctcatggtgagcgtaagggcctggcggggcacctcgtcgatcgaagcgaagcagccgtcgtttacctgctgcatccggcacacgtcgtcgagggaaaccactttgacgcgtctggggtcgttaaaatcggccacggccgggtcattaaaagccagatggccgttttctcccacgcccaaaaaaatgagatccggaggatactcctccagcaaggcggtgtatttttcacacatcgcttcggcttcgtccggcgggcacgccatataaaacagctccccaaaggggacgcggtcaaaaattgcacggcgcaggaaattgccgaagccggcgctgtgcgcggggtccagcccgatatactcgtcctggtgaaacccccggacccgccgccagtcgatatcctgcccaagcagcgaagcgatcaggtcgtcctgcgaaggggccgccgcgaacacaacgttcgcttcgccttttttgtcaatcgcttcgcggatgatatgagcggccccccgggctgcggccgcgcccatttcggcgcgtgtatcaaacacatggacgggcaggccgtcgatgatttgctgttgcctttccatcgtgaaaagtctcctttatcgttgttattcttcgcgcacgcccagataggcggccgcaatatcgggatcgtccaacatctgcctgcccggaccggatttgaccatgcggccgttttccagaacataggcatagtcgcagatggacagcgatttttttgcgttctgctccaccaggatgacggtgatcccctcgtcccggatacgccggatggtgtcgaacacctcgccgacaatgattggggcaaggcccagagacggctcgtcaagcagaagcagccgcggcctgcccatcagcccccggccgattgcaagcatctgctgctcgccgccggagagcgtcccggcgtcctgtccgtgccgctccctaaggcgcgggaacagctcatactggcgctcgatcagctcccgcacctgccgcgcgctggagtttaagtatgcgcccagccgcaggttctcctccacggtcaggcccgcgaagatgctgcgcccctcgggtacctggatgacgcccgctgagacgacgcggtgggaagcgccgggcagattcttcccatcgaagcggattgtgcctgtgcgcttgaccatcccggaaatggcgcccaggagcgtgcttttgcctgctccgttcgaaccgatgatgaccgtgatctttcccgcctcagcatccatatccacaccgtgaatggcttcgatctgcccatagctgacatgcaggccgcggatttccaaaagcgccatcagacttcctcctcccccagatatgccgccaaaacggcggggtccttctggattttggcaggcgggcctacggcgatggtcctgccgaaatcctgtacatagatcgtatcgcaaagcgtcatgatgagatccatccggtgttcaatgaccagaatggagagctggaagcgctccttgatcagacggatgaaatcgatcagagccaaaacctcctccgggttcagccctgcggccggctcgtcgagcagaaggacgcgggggcggctggcgatggcgcgcgcgatctccacgcgcctctggatgccgtaggggaggttggccggccgcgcgccgctatgctgggagagatttaaaacctccaggcagcgggacgcctcctcggcgatgcgccgctcctcgcgctggcggcgcggcaaaaggaacatggcctcaaagaggttgtaccggcccgcctggtcaagccctaccttgacgttgtcgagcaccgaaagtccggcaaacaggcgcgtattctggaaggtgcgcgaaagccccatgcgggctacctgtacctgatcgctctctgtgatatcgcgccccagaaaggttacgcggccttcgctgtaatcgtagatgtgggaaagcaggttgaaaattgtagtcttgcctgcgccgttcggcccaatgatgccgccgacttccccctcgtgcagctccatattgaagtcctgcacagccttgacgcctccaaagcttttggaaagatgctctgtctttaaaaggatgtcagccatctgtgccgccctccttttttttgcgccgtccggacaggcgctccctgagccggctaaagctgagttcgtgctcacccatcaagccggacggacggaaattgatgattaaaagaatcaggatgcagtaaagaatggtgcggtattcctgcaagctctggccgaacagcgtgacgttgcgaaaaaattcaggcaggcatttgagcagtgctgcggagatgaccgcgccggtcaggctgttggtgccgccaaaaaacagaaatatttcctgttccgaggaagctgtccagccgaacgactccggcaggagcacgcggttttgcagcccgtacagaatccccgcaagcccagcgatcacagagcctaaaatatagaccttgattttcagcttgtacacgtcgataccaaagcttttggccgcaagctcgtcgtttttcagcgcgatgctcatgcgcccatagcgggaatatttgaggtttcgcacacaaaaaatggaaagcgccgtcacaagcagcgcgagcggcagcagatgctccacctttgggattttggaaaagccctgcgagccgtttgtgatatcggaaaaggtgatgagcagtgcggtgatcgtctgccccaatcccaccgaaatcagcgagaaataatccttgcgcaggcggacggtgggcatggcggccagccaggccaccagtatacaggcgccgatgccgcccaggctcgtgatccaaaaggaaagccctgtttttgccgccagaataaaggtgatgtacgcgccgatcgccatataggccgcctggccgaggctgaacataccggccagcccggtgagcgcgaaaatgccggtgatggcgatgatggagatggacgcctgaatcagcagtccgacatagtaggaattcatagcatcgccccctataccttatcctgggcaaatttgcccgaaatgccctgcggacgcaggaacaaaaataccagcatgatgccgaacaggatggccggggtcacgctggaacccaggaaatagatcgaaaccatttcgatcactccaagcaggatcgccgcggcgatcgcgcccgaaaggctgcccaggccgccgatgacagaagcgataaagcccttgaccatcatcgaggagccgagagcggggtagaccgaatacttgatgccgagcagcgtacccgacacaccagccaaaaagccggccagcgcgaatgtaaaaagcacaataaagccggaattgatccccatcaggcgcgaggcccttgggttgatcgcgacggcgcggatcgccaggccgatctttgtccggttgatcaacagcatgagcacaaccagcatggcgattgaaaccgccagcacgaccaaatccatcgtggcaaacgacgcacccagcagacgcaccgaggcgacctcgaacatgccggggaaaccataggaggtcttgccgaaaaagacggtgaggatttgttcgatcagaatagcaaatatgatcgaggccacaaagtagtaaatgttggggctgttgtttttgcggatgcggcggtaacacagcgtgtcgagcaaaagcgccacgcccaggctcacaaccgccgtgaaaagaagcgtaacccacagagacggcggcgtttcaaaggatgcgtaaaagaaataagcgatgtacgcggcggcggaaatcatgccgccgtgggcaaaatttgaaaatttcaggatgctgaacaccagggcgaagcccacagcgatcagcgcatagactgcgccaagggaaatgccgttgacaatcaattgcaggctcaagcaaacacctcctgacagataggggctgccggaaaacaaaacgccgcggccttgggcggccggttttgccggcagcccgggcagggacgccgctgtaaagcggcagggcaaaataccgctcctgccgcttcacggctatttcgcaaaacgcaaacggttctactgatcccattcttcgctcagggtataggtgtcaatcaccttcaccgtaaagttttcgtcgtactcggcgatcagcatgggcataccaagtgtacggtgggtcttgggattgatggtaatgggtccagccgcgcctggggcgtcctttacttcggcgagggccgcggcaacggcggggccgtcataagggtcgtccacagccttaagcgcctcggccagaaccatggtggcgtcgtagccgaagcaggcgttggcaatcggatattgggcgccggtttcctccatatatttctgcacaatggcataggagggatcgtccggattctccatatccacgttctggaggaaataagtatcatacacctttgtttttaccagtgtgttgaagggcgcctgaaacgtattgtttccaagcacgatcccctggtagcctgcctcgcgcagataatcgtagcacaaagcgttgtcggccgcatagttgcagatgaacacagcgtccggattggcctgcgccagcttgacggcctgcgcgcggtaatccacgtcgccggtctggaaggattcctcagccaaaacctgaccgccgttttttgtgatataatcggcgaacggttcggcgtgcatgaccgcataggaaagcccggcgttatagaaggtgccgacggttttgacgcccagcttttccatggcataagccgcgatggaatacgattgctgcgcgcagcccggctccgccaggaacatatagggatacggctcgccggtgttttcattcgtggtgcagcgttcatccataaagtggcccacaatcgggatttcgtcctctgtggacaaatccacccatgccagcgccgggttagagagcgggggaccgacgattgcggcgacgttcttttcatccaccagcaggcggtagcagttgacgccctcctgcacgtcgtttttgcagtccattgcgatcacctcgagcggacgtccgttgatgccgccctgttcgttgatgacgcgcaccgcgtattcaacgccccaggcgttggcggtgccggcctcggaagcgccgccggacaaatcctgaatggtaccgatgagaatcgcattttcatttccagcggcggattcttccccattggatccggcagcgccggcagcttgcgagggggcgtcgctctggctgtcgttaccggcggcggaacatccagccagcgcgccaaaggtgaggcagactgccagaatgcccgcgagcgttttgtttttcattgcgtgcgtcctcctttaaaaaagataatttttatttctgcatggccatcatgcgaaatgatacacatttagtaaatgttttcttaaccagcacatttgccaaatcagccaaaatacaccatttgaggtcaatttcaccaattttttgtttatcatttgtaagtttctagctttattatacgattattttagaaaattgcaagctaattttcagaaaaaataagaaaaattttagaaaacgtttaccaaaatattgacttttatataccttactccctataatgaaaagcagaaaccttgagaattgttccgcaggcgggggttatttaaaagaggaattgcctgctttttcgcaaacagcccctatccttaaattgtaattgtcgggaggcacgcgcatggaaattggcgtcatcggcgcgcagagcaaacacaccgagcttttctgttccctgatcaacacctcgcccttgtttccccggatgcgggccgtttccctctggggcggcgactgccccgaacgggtcggctggtgcatggcggaaggcgggctgcaaacgctctgtgaccggcccgaagaagttatcgaacgcagtgacggcgtcatcatcacgctgcggcgcggagaaacgcacaaggcgctcgcgttggcttgcctgcgcgccggcaagccggtttttgtcgataagccgttttgcgatagcgtgccggacgccgccgcgatgatcaatctgtccaagcagtgcggcacgccgctgaccggcggttccacgctctgctttctcccacagatcgcggagcttcgcgagcgggcgcgccactgccgcagccttatcatctcctatgcggccgattgcgattcgcccttcggcggctggaacttttacggcagccatctggccgacctgtgctctgcgatctgcggctgtggagccgaaatggtttcggcgcggcgtacaggcagactcatggacgttcttgtacagtaccccaaccgaagcgttctgcttcactccgatcccacgcttactgagccggccgtgacattccacagctgggacgaggagtactgtccgctcggcgacttcgaccgctgctatgaatacggaatgcgtgcgtttcgcgacatgatggaatccggtgttggccaaggcgcgcagcgtcttttattttccacgcgcctgctggatgcaatcggccgctctctgcaagaggcacggcccatcccgcttatataagagcctgtatccacagccgtaaaacgccgtccaggcgggtcttttgcccctctccacgttaaattttcctgccgggcggcagcccgcctgcaaaaattcgcattgatcgggtacaaaatccctcgcctgtccagtatcctccgactgtgaatacaggttctaagcgggataggccgcgccacagcaaaaaagcaggggcggcgcccctgctttgtaagtttcttattccgcctgcccgcgcagatcccggacgctttggcgctcgatcagaatcggctgcaggctcatatttaaattcaagctcttgctgccgtcgccaagctgatcgatcagcatcatggcggccagccgccccgtttcataggacggacagcggatcgttgtgatcggaggcataaagctctcggcaaacgggatatcgtcaaagccgacaaccgacaaatcctccgggatacgcacgccgctgcggcgcagctccgcgatgacgccaaaggccaccatgtcgttgacacagaacaccgctgtcacatccgcccggcgttccaatatctgctgcgcaacgctgcaccccgcgtccatctcatagctgccgctctctaccgcttccacaggctcgctgataaagaccagcccggcggcttcatcctgaaagccccgctccgccatttcctcgcggtagcccttgaggaccgccttacgcgtccagcgtgtcagcggggtagaggcgaacgcaatccgccggtgtcctttctccgccagatgccgcacagccatgcgcgcgcccagctcggaatcatagttgatacaggcgcactcctcgcgttcaaaccgctgatccaactgcacaaacttcatgccgcgggacagaaaatccgcgacagagctgtgctcctcgtccgccgacgagaggatcacaccctgcacctgccgggcataaagctgctctaaaaacgcgcgctcccgctcaacgctgcgggcggagttgcagagaatgatgtgataatttcggtcgtaacagaccgccgaaatcccctggatggtctgcatataaaaagggtttgtaatattcggaatgaccagcccaatatcgcggctaccgccgccgcgcagcttttgagcagccgcagaaggaacataggaaagcgcctcagccgccgcgagaacccgcttgcgaagctgcgcggtaacgccatagcccgaatcccccaacacgcgcgagacagtcgccacgctcgtttgtgcaagctccgccacgtccttgatggtcgcccggcccttcttcgtgtccttctccgccatccatcccaccccttgtccaatgatcctttttattttacccgtttttaatcaaacgcgcaataccaaagcgtccaaaggctttatacggcgcgcccggcggccatcgccgcaaatctgaataaaaggagcttctcttatgaattcttcacaggaactgctggaacggatcacacgcccctcgccccgcctgatcgatgacatcgccaagatttcaggcgatatcatgattgtgggggcgggcggcaaggtggggccgagcctcgccgtcacagcccggcgcgcctgcgaggccgcgggtcttacaaagcgtattcttgccgtctcaaagcttgacgaaccagccgccgcagagaccatgcgtcattggggcgtgcaggttgtagaagccgatctgctggattcgcagcagctggacgccctgccggaaatggacaacattctctttctggcgggacgaaaattcgggacctataaaaatcaggcggacacctgggcggccaacgtgctgctccccgctaaaatctgcgaacggtttccaaaagccggcatcgtcgccttctccaccggaaacatctacggcgaccgtcctgcccgctgcggcggatccgtggaaaccgacgcgcccaatccggatggcgaatatggtcagacctgtctcggccgggaacgggtgttttcctattacgccaggcgcaataaaacccgcagcctgatgttccgactcaattatgcggtcgatctgcgttatggcgttctgtacgatatcgccaaaaatgtgcgggacggtatccccatcaaactcggacgcagcgtcctcaactgcatctggcaaggggatgtctgcgaatacgccataccgcgctgctccacgtggacgcgccgcccgctgtcctgaatgtgaccggaccggagacattctccacgcgttgggcagccgaacgcttcggcgatctgctggggcgcgcccctctctatgaaggcgaggagcagaacggcggaattttcagtaattcatcaaaactgatggagttgatgggatatccctctgtttgcctggagcggatgatacgttggcaggcccagtggatactggacggcggctcctcaatcgccgcgcctacgcacttcgatgcggccgacggggtctattaacccgttgcgccgctttttatcagccatggacggagccggctttaagaacatgcgtccgcagtcgtccagcgccgggcagatcattctttcgcctttgctccgcgtaaaattttccctgaccgggagcgccacttacctgtccagcgtccttcggctgagaatacaggtcccaagacgccctttatcaacaaatctgatatgtaacaaagaaaggaaggattcaaatggcaaactttcacatcaagggtaaaacggccgttatcacaggagccagcggcattttgtgctccacgctcgcccgcgaactggcggcgcacggagccaaaattgcgctgctggatatcgcgcccgaacgcgccggacagcttgcccaggagattaacggcgccggtgcagaggcggtcagcttttactgcgatgtattaaaccgtgaaagcatcgagaaggcagggcaggcggtcgccaaccgttttggcggcgtggatatcctgatcaatggcgcgggcggcaataagcctgccgccacggcaagcccggaactgagcttttttgatcttccgggtgacgcgctttcctgggtgctcaacctgaatctgatgggcaccatttatccaacccaggtctttggccggttcatggccaagcaaggaagcggctgtgtcgtcaatatctcctcaatggcagccttcacgccgctgacaaacaccgtagcttacagcgccgcaaaggcggctgtctccaattttacccaatggatggccgtttacttcagtcagaattgttcgcccaaaatccgagtaaacgccattgctcctggatttttgctcacgcagcagaatgactacctgttgaaaaatccggatggaagcgacacggagcgcggccgcaaaattatttccggcacgcctatgggccgatacggcctgcctgcggagcttgcaggcgcggtgatctttctttgctctcctgccgccagctttattactggcgcggtactgcccatcgacggcggattcagcgcctattgcggcgtataaacgacataagtacagtattatggcagccggccccggattgcattgacaatccggggccggctgccgttcgcgcagacagcgtccgcttaataattttccgccttgacctggaaccagctctgcggcttttcgcagactgggcagacctggggcggctgcgcgccttcatagacgtggccgcagttgaggcagatccaggtgacgctttcctgttttttgaaaacagtcccattgtcgacattggccttcagcgtttcatagcgttccatgtgttctttttcaattttggcgaccagctcaaacagcgcggcgatctttgtaaagccctcctcacgcgcttcttttgcgaaagttggatacattgtctcgtactcataccgttccccgccggcggcctccatcagattttcgcccgtggccggcatcccgttgtgcagcagtttgaaccagatttccgcatgttctttttcgttgttggccgtctcgagaaacaggttgccgatctgttcaaagccgtccgccttcgccttcgcgccgtaaaatgtatacttattgcgcgcctgcgattcgcccgcgaacgccgccatcagattcgcttccgttttggaacccttgagaattttttgcataaccatcgtctcctttacagattagatggcattatctttcccatttttctccttgttcattcccgctttccagcctttttgaaaaaaggcccccgcttttttgaaaaaagcacggcaaaaaactgcttaccttttttgaaaaaaaggtaagccaaaaaactttattcggctgcgccgcgaacagcggggcgggttccagtatttttacaggctgcgccgcgaacagcggggcgggttccagcatttttacaggctgcgccgcaaacagaggggccggtttcagcattgatgcaggctgcgcctgtcccgtgaggcgcgccgccgcggcttatccgcgcccggcgctatagcgccggattgccaagacgcaaaatttcacgtaccattccaatcctctcccatcccggcaagaatcgttttcagaatatctgctctgcgcgctccaatcagcgtgcggggcgggttttgtttactccttttcggcagcctttttctgtgcggctgcctccaaaatatcctcaagattgtccaaaacaaactgctgtgccgcacggttaaagagattcaccagataggtatctccccgttcatttttgcgctcctcgcgcgagatgccaagctgaacgcctgcttgcgtcggcacacgggtgcggcttgcttcgggcttttccaaaaagcccatctcctccaggccgtcggcaacctttgcgaatgtgagctgtgtatcgctggtcagaaccgtgacattattaatttgttttacaaacccggtcaaaggaatcggttcgtcgagcacgcgcacgcgcgttttttgctcgggcgtaatcgaaaacggcggctttcttggcgctttgcgccggccgaccgtcccgccgttttcgatgacctgctccagaatgccggatacataagcaaagcaacgcgacaaccggacattgcttaacacgccgtcaagtggaagcgccgaaccgctgatcggatcgattcctctcgacagcttgtccagatacatctttgcacgtttcatcgtatcaagctcgttcatacagcttccacctcttaaattccccaaaattgtactatattcctatttttgcagcttgttggaaatcagtttcattataccattgcttcctgcaaaagacaattgccgccaattgccgcattgcgctgattatttttaacagcacacaaaaaacaggcgtgctgtataaaaaaagaacacaggcaagctgtgttctttaagacaatctattgcatcctgtttctcaatacaaaatgaactgaactccacaaaagaatactatacgtaatcaggccggtaatgagatatcttatatttgcgtgccttttattctcacggtcccggaaaaattcaaaaaatgtccagccaatcatcatcagccatccgcacgtagtcataaccaaagcaggcgttccacggatcgacggccaaaagtgggacagagccaacagtaccgcggccgccttatagatataggagaatgcttttcctttcggctgtaagttcaaagctctatcgattcactcccttgcaggcgcatcggatatgacccctcataatactcatggaaggtgcctaaataggtcgttttcccattgctcacggcatatgccttaaccgtataatgcgattggaaataggcgaaggtgccatctgaataatgcgcttctctatactccttttgaaccgtgccatatgtataacagtccggccaggcaatcgcaattgcagataaagcgccggaaatttccccgccaattgatcgcgcggcactcggcggcaaacaaaaagatattgcccctgttattgtgctggtggctgaagctagcgattttatgtcggtgctccagctctcattcccatttccaaaccaagggccatacgtgataccgcttgcccgtgtatctgcatcaaatgattctgtgggttctccgggagcagcagcgaacacacttccggtcataaaggcggtaatcatgacaagtacaataagacccgaaataagctttttcattttacctctccttcttttcatgtcggttgcctgctttgatgcgtctttattgtatcctttattttcctgtttgtcaattattttctaaaatttgttttaattgttaattataacagttatctatacacaaatcaaaatagaatcatgtgctgaatttactattccagattctggattggcattttttgaatcagcgcgcgtgggatatttttttatggaaagtgaacactaacacagcatatgaatcttgaaacgagggatgaaacctatgaatatgacaccggaggaatacaacgaacttacaaaacaaagctccccgcgatcgccgttcatcaaggactttcttttggcgttcactatcggaggactgatctgcgcgctcggacaggcgattatgatggcataccagtcgtctggtatgaccgaggaggtttccggcagcgtcacttccgtaacgctggtccttctgtcgatcatattaaccggcttcaatatatatccgaaaatcgccaaattcggcggcgcgggtacgcttgtgccgatcaccggctttgcaaacgctgtggcctcgccggcgctggaattcaaaagcgaaggtctggtgcttggtctggcggcaaaaatgtttgtaatcgccggcccggtcatcgtctacggcaccagtgccagtatcgtatacggactgattatttacctgttcggattgtattgaggaggggcgtttatggcaaagcgtaaagggacctataccgttgtgtttgacgaaccaatcagcgtgcgcgcctctgcggccgtcggctccaaaaaggaatcggaaggaccgattggccacgcgtttgatgtgatcaatgaggacgactactttggcgaaaaaacatgggaaaaagccgaaagccgtatgcagcagaccgcgatccaaacggcgcttgacaaagcaaagtaccagccttccgacattgactgcgtgttcgcgggcgatttgatgaaccaatgcgtcggctcaacatatggcctgcgctcctttggcatcccgttcgtgggattgttcggggcctgctccaccatggcggaaagcctgatgactgcatctgtttttcttgacagcggcgcggcgggccgggcggtcgcatgtacctcgtcgcatttctgtacggctgaacggcagttccgcctgccgcttgaatacggcggccagcgcacgccgaccgcgcaatggaccgcgaccgccgcaggtgcggctgtccttgaaaaaggcgatacaccgccgtttatccatgcggctacgatcggcaccattgaggatctcggaatcacggacgccaacaacatgggggcggccatggctccggctgcggccgcaacgatcaagcgatttttcgacgataccggcacaagaccaaatgattacgaccttgtaatcaccggcgaccttggcaaagtgggcggcaccatcctgcgtgacctgctgcggcgggacggctatgaccttgaacactgccagaccgactgcgggctgatgctgtatgaccttgaaaaacaggatgtacacgccggtgcaagcggctgtggatgcagtgcttccgtcatgtgcggacatatcctgccgctgatgcacaccggccaactgcacgatatcctgtttatcgcaaccggtgcgctgatgaatacaactgtggtacagcagggcgagagcatcgcatcgattgcgcatctcgtttatctttcatcaaaaaagaagggagggcttgtttcatgaccattctgatcgcgctgctcaaagcgtttcttgtcgggggactgatctgcgccatcggccaaatcttcatcgattatacaaagctgacgcccgcgcgtatcctgaccggctatgtcgtcgcaggcgtgattctcggcggcgtcggcctttaccccaagcttgtcgaattcgccggcgccggcgcgacggttcctctgctcggctttggcaacacgctcgccaaaggcgtgcgcgaggccatccaggaggagggcctgctcggcgtattgaccggcggacttggcgccacagccgccgggatcgctgccgccatctttttctctctgatcatggccctgatctttaaacccaaaagcaaaaactgatgctaaggcgcgcgcagcccatgcgcgggccgctcaccgccgggcgcttcgcttgcccggtcggctatgcggtgctttccggcgctacaacgccgggcgcgtccaagcggcgactgcgcccctttccacgcctcacaaggggagtgtcgcccgacactccccttgtgttatccccaccactgtttggcacggatttttcgggcgcacgcctgtacgttctgcggtaaaccgtcaagccgcgcccgccccggggttgggttcatagggtaggggcggccgggccgccccgctctttacggcacaaccggtagaattccaaaacccgccctactgttcgcggcgcagccggctaaagttttttgccaagctttttttcaaaaaagcgggaaagctgttcataggcgggcgctgggacgcccagttcgtgcgcgatgcgcgccggctcaaagataagtccgtcaatctcgctgctgccgccctttttaagatccttctgcatcgacgcggtcgcgtcaggggaaagcgcgtcaagacgccggagcgaattttcaaccatatcgtcagggaatctgtatccacgcttatccgcaatggcttggagttcgcggataagctcaataaacaggtcatggccttttcccggcgcggccagctcgccggcggtcatatcataataagcgccggccgcagccagtggagatacaaacatgaacttgcgaaacgcgtcgcggcggatgtcgtccgaaacgacaacatcgatgcttgcgtcacgcagctcgccggcgattttattgagacgcccgtccggctcatctgtatcgcgctgcccataaacgatgcgaaacagatcgccggtctgcgtgacttctcccggaccgctgatatatgcgccgatataaatgcagccgtcgagcaccaggcgtccaggcaggcgcggtgcaagccgttcgcctgtgccgacgatattgagcaccggaatgacgacgctgcccgcgtcggccgcccggtcgatcagcggcacgacttcatcgattgaatatcccttgacacaaacaaatatcacatcagcacggccggtaaattcatcggccgtgcacgcctttggatggacgcacagctcgtcgccgcggcgcgtattatacaggcgcagccccctggaatggattgcttccagatgcctgccgcgtgcgatcagcgttacgtcaaatcccgcgtccgccagataaccgccgatgcagccgcccacaccgccggctccaatcaccagatatgtcatgcagattgcccctttcccgctatttcagagcgtgcagccggcgcatagcaagctgtgcgtcgagcatcccggatttatacaagctttcaagacgccgcaaatccttttcaaaccggctgatttcaacgggcagcgacggcgcgatgacgacagccgtaccatcgcgctcgagccgccgtataaaatcaagcgtttcattataaatttcatggcgtcggtcgagcgcgcgcgccaactgcggatactcgcgaaacatccggtgatacagcgtccgaaaatgctcgggcgctttttgataggaccggtcgcgcgtgagcacaatgacaaggcggccgcacccatcggcaagcgcgcggcgaaccgggatcgggtcgcttgttcctccgtccaggtaacgtccgccgcgaaacgatacaaccggcgaaaagcccgggattgacgacgaagcccgccacaacgtgctgtcgcccggcgaaacggccgatttgtcaaagtaaacaggcatacctgtttcaatatcggttacccctgtaaccatttcaataggcgaggctaaaaacgccttatagtcgaaagggtcaaggcggttcgggatttcatcaaaaataaaatccatcccaaacatggattttgttttgatgaagctgtccagcccaacataccgtttatctcctaaatatccagtattgatacggtagctgcgtccgcgctggccggagatatacgacacggcgctgcacgcgccggccgacacgccgattacataatccggataccagtcgttgtccatcatacagtcaagcacgccgttcgtatacaggccgcgcataccgccgccctccaggacaaggccaatcttcatgcaggaacctcttttctgatttaaaagcagattgcagacgcctcaaagcaaatcaagctccacggggcagtgatcgctgcccatcacatccgcgcggatacggctgtcatgaaccgcgccgcgcaggcgttcggagactataaaataatcgatccgccagcccgcgtttgtatcgcgcgcgcggcgcagatacgaccaccaggtatatgcgccagtcacgtcgggataaagcgcccggaaggtatccacaaaaccgcccgcgagcagctcggtcatcttggcgcgttcctcgtcggaaaatccggcgttgcggcggtttgttttcggatttttcaggtcgatctcctggtgcgcgacattcaggtcgccgcacagcaccaccggctttttcgcgtcaagcgacataagatatgcgcgaaaatcatcctcccacttcatccgatactccagccgcgccagctcacgctgcgcattgggcgtatagcagttgacaagataaaacggttcgtattccacagtgatcacgcgtccctcgctgtcatgctccgccataccgatgccataagttacattcagcggcggcacacgcgtaaaaacagccgtgccggaatacccttttttttcggcgctgttccagaactgctgatagccgggcagctccagatcggcctgttcctggtgcatcttggtctcctgaaggcagacagcgtccgcgtccgccgcgctgaaaaagtcgaggaatcccttccccaaacaggcccgcaggccgttaacattccatgaaaccagcttcataagctcctcccgggactgacatcccctgtatcttattttgccccgcgccgttgacgtacagccgcatccacgttatgatgagactgctcatatataagagatcgggggatttgatcatgaaaataaccgaagtatcaggcgaccgatgggcataccgcgacctgcttttgctcgccgatccgtccgaagaaatgatcggccgctatctgccggccggctttctgctggccgctcatgaaggcggcgcagccgccggcgtcctgtccgccgtgcccgtcgaaagcggctgggaactgaaaaacattgcggttgcgccggcattccagcggcgcggcgtcggacgcgcgctgatcgacgccgcgctcgcacgcctgccagccggcacgcgcgtactggtcggcacgggcgaaacgcccgcatccttcgcgttttacagcgcgtgcggctttacgctgtcccaccgcgtgaaaaatttctttaccgacaactaccctcagcccatatgggacgacggcgtcctgctgaccgacatggtctattttgtccggcttttttgaaaaaaagcctcggcaaaaaacttcttaccttttttgaaaaaaaggtaagccaaaaaactttagtcggctgcgcccccgcttttttgaaaaaaagcttggcaaaaaactttagtcggctgcgccgcaaacagtgggacaggtcccggtatttttacaggttgcgccgcgaactgcggggcggacgcagcgcgtatacaggctgcgcctgccccggagttgtgtccacgggatagggccagcccgcccctgtcccataaggcgcgaaaaggagcgctgccgcggcttgtccgcgcccggcgcgatagcgccggaaagccccgaatagccggccgggcaagcgcagcggcccgcgcacgggtcgcgcgcgccaaagcgcctgcttgacgcattttaagcgcgtggaccttttagaaaagccggagcagaagcatatagacggtcgtggaaatgccgatagaaagcagattgttgcgtttccaaacatggattgcaactgtcaaactgacagcgatgatctccggcgcgccgaaggggacggatgcaaaatcgatgccgcgcaggcagtagaccaccaggatcgcgatgatcgcatacggcagcacgcgtccaagatagatcaccccgccggaaacaggacggccgtctctgaacagcaaaaacggaagcgcacggcacagtacggtgacgccggcgaccgtaagaaccacagcaagcgtttgaagcggcgtcagcggcataccgcaccgcctccctcctgcgaaccattcaggcgtttttccaacggccggcggccggccaaaagagcgccgacggtcaaaagcagcgccggcggcagaaaaccgtctgttccaaacagggcaaggcagaccagcgcgcatccaagccccgtcagggcgggaatatgcgtttttgaattaagccactgttcgacaaaaatgacgataaacagcgcggtcattgcaaaatcgatgcctgtggaatcgaagggaatcagctcgccggccgtcgcgccgatcacactcccggctatccaatagcactggttgagcagggcgatcaacagatagaaccggccccgcggcatcgctttaggcggcttgatcgagcaaagaagggaataggtttcatcggtgagcgcaaaaataagatagagctttctgattcccagacccttaaacgcctcgatcagggacaggccataaaacgcatggcggatttggaccgcaagcgtcacgacggccacatgcaaaaagcctggccagcccatgagcagttcgaccaagacaaactgcatcgaaccggaatagacggtcaggctcgacaaaaaggcccacagcacgccgtagcctgtcttttgcagcagcaggccgaacgccatgccgacaaacacatatccgaaaagaatcggcgcggtcgcggccgcagccgcccgcagccccctggtaaagctgtttgacatcgccctgaaagcgcctcccgccaagaccgcgcagcggcccgaaatgatagcgcacagtggaaaacaatgtcattctagcatacgaaacagaaaaaaacaacggattccaaaaatttattgctttaaatcgatttgaaaaaacggttccggcatcctgcaaaacgacagggcctcatgcggtggaagacgacgccccgtcctccggcgccgcgtcgagcacctgtttaatgacattttccatcatctgttttgtcatcgcccccggcgcgtagccaaagatattgccctgcgcgtcgattaaaaaggtggtcgggaaagcgctgataaaataatcggaaaacacgctgcccgtcgtgtcatacacgcttgggaacgtatagccgttgtcggttaaaaactgcgcgatttcctcaggcgagccatcctgcccatatggattttcatccgtctttggatttgtcacacctaaaaatacaacgtcgccggtgttttgcccgtattcattgtaaagctcctcgatgtggggcatctcctgccggcatggcgggcaccaggtcgcccagaagttgagaaacacaactttgcccttgtaatcggacagggtgtgcgtgttgccgtactggtcggtcagcgtaaagtcaaaagccgggatgacatcggcctgctcgggcgaggaggaggaaggcgccggggacgaggacggcgcctgtgcgccgggatcctcggacgggcccgactgctccggcgcggcctgcgaggacgaggtggaggccgcttccccatctgaaacggacggcgcgccgaatgagcttaaatagccagtgacgccgttcatccaaccggtaaacgtcatgacgccgatcaggatgagcagcgcgccgcccgtcttgatcgtataacgcatcagctttttgtggctgcgcaggaaattgagcgcctgcgttgtaaacagcccaagcgccagaaacggcaggacaaagccggccgcatagagcaaaacaagcaggttgccggtcgcggcgcttttcgcgccggaggcgagaatcagcacagatgaaagcgccgggccgacacacggcgtccaggcaaaggaaaatgtaaagcccatcacaaacgccacaaccggattcatccgcttacccttcatattcagatggaagcgccgctcccgctgcaaaaacggcagctcgaaaaagcctatctgcacaaggccaagcaaaatgatcacaacgccgccgatgcgcgcaaacaatgttttatgcccggaaaaaaacgtcccgatcgccgtaaacgaaagtccgagcagaaaaaacgcgaatgatacgccgaggataaaaaagacggtatgcagcatcacgcggccgcggtgatagaccggcgcgcccgcttcatcgcggtcggcgctgcccgccagatagctgacataaatcggaatcagcgggatgacgcacggcgaaaaaaaggacaacagtccttcaataaaaaccagggcgaagctgatgtgctcgcctgtcagtaagctctgcatataattcctcctgtggattattaggtaatattatacaggaacggtgtagaaaagggaagggcgattttgcatctgtggaagatttatgctattatatacaaaacagacggcggctgacggtgacgccggtcacggaaagcggggaatcacatgaaaaaggttcgcatcactgttctcaagacgacattcgacgaggagcttgcgcgtgagtacggcgccgaaggcttgtccgcctgtccaatgctgcgggagggtcaggtcttttacgccgactatgccaagccggccggcttctgtgatgaagcctggaaggctatttaccagtatgtgtttgcgcttgcgcacggggccggcgaacatattttttattacggcgactggatcagaaaaccaggtgttgcgatctgtagctgcaacgacggccttcgtcccgtcatctttaagctggaatcgaccggcgagacttcgcagatcgactatacgccggtgagatgaaccggctgaggggccggacggcaggtatgccggatgcggcaggcacgctgcggcatgtgcaaaaaagcgcgtgtccccgggcggccaaacggtttgcgcgagcctgagagcgggaggacggctgaaacggatgaatgacaatgattttatgggcgaggcgctccggcttgccgggtgcgcggcggagcgcggggaggtgccggtcggagcggtcgtcgtgtgtgacggacagatcgttgggacaggctttaaccggcgtgaaaccgggaaaaatgcgctcgcgcacgccgagcttgaggcgattgacgcggcctgccgccggctgggcggctggcggctgcatcggtgcgagctgtatgtgacgctcgagccttgtccgatgtgtgccggtgcgattatcaatgcgcgcatccggcggctggtgttcggcgcgcgtgatccaaaaagcggctgcttcggctcagtaagcgacttcaacgcgctcgccttcaatcataagccgcaggtcgtctgcggtgtgcgcggtgaggagtgtgcgcagattctctcagcgtttttccaaaagttgcggcgcggtcgccaatagggcacaagatgttgtgtctgttcacaatttgttcaccattttccggcacacgcatgatataataagtaatggaaacgcagtgtttctaaagtgaaatcccccctcctttattttatctccggatcatttcatttgcagcgggccgtgcggctcgttttttttttgcagttcgcgccggcgccaggcggttcatcattttttaaaaacaccaattttatacagcgcccaaataatctatacatcgcgtgtaaaatatgagataatagaagccgcaggcggcatcgtccgcggcaaaatcacttgaacattgatggaagccccggacggcggcttcaggaagggaacgacatggacagctattttgtcgagattcagcggccgtttatgccgccctcggacgacgcgcgcctggtgttgattgcggacggctcgctgcaccgcgcgcttgaggatgtcaaacggcatctgttttcctgtgtgaaatacgccaaaaagcacggcgtttatgtattgacgggcctgttcgcgcacgagggcaacctctgcctgtgcctgctcgatccgggcggcgaggtggtctgccgccagccggccatccatccgtccatttcgtttcagggggagtttctgcccggcgaccgcatcgaagtggcgcacgtcggcgagcttggaaatgtgtgcctgtgcgtggactgcgacatcaatgatccgcgcgtgctgcgtgcagccgctctcaagggcgcggacgtcgcactgtcggtccaggcgctcgacccggtgcaggatgcgggcgaacgcctgctgcgcacagtgtggagcggcgcgcagggcaacaacctgtatgtggtcaacattgcggcgggcagcgccgcggttgcatgtccggcgggcgtgacacgcgcgggcgacgggtatctgatccgccagacctcctctttcccggtgcgttttgggctgaatatggcgcgtctcgatgaaatccggcgaggtctgcggcttttggaacagatcaatcccgcgctgatcgcaaactatgaagccgagcttgggaggtaaaaggcatgtgggaagtgctgctgccgctgatttctttttggatgtcgtttcgggtgaccccgaaaaaaatcgacgcgctgctttcggaaaaaagcggcgccgcccaaaacaacgcggaatttgctgcgccggaggcggtgcgcgccgcgtccgtccaattgacggcgcgcgcatataaggatctgcgcgactatatggacgaagtgtatctgcttgccaaaaacgcggtcgacgccggcgcgcaggttgtcgtgtatccggaatatgtgggcgtactcgctctgaccatgctgcccctgagcaagcagattctcaactgggtgctgcacgggaagcatttcatcggtttggacggcgcggcacccgatccggtgcgcatggctgccgtgcttgaaaccttcggcggctttttaaacgagctgtatcagaccgccttcagcgggatcgcccgtacgcttcgcgtttatgtggtcgccggcacgacgctcgtccgcgaggaggacggccgcctggtcaaccgatgcatcgtgttcggcccagacggcgaacaggcgggcgtccaggataagacaagcgtgctcgggttcgacaacgacgccggcgtttcgccctccgatgtcctcgagccgatcgacacgccgcttggtccgctcggcgttgtcatcgggtcggacgcctattactttgaacgcttcaaaatcctcgcggagaaaggcgcgcgcctgatcgccgtgcccgacgcgcgcggcgggatcatgcccgatctgctgcgctgccgcgcgaatgaagcgggcgtttatgcgctatacgcctgctatgccgccgggccggacgaaggtccgaatgtgcgcgccgcgatctatgcgccgttcggcgcgacgcccacgctcaacggcgtcgtcgcctatgcgtcaagcgcgcatatctgcgctgtaacggcgcgcacaaatctgcaaaagctggccggcgacctcaccgatccagcccagacaagccgaaacgaggcgtttaccaaaggcgattacctgcacagctaccgctactgcggcaatctcccctcaagccttccttaaaaaatagaatctctgggctggccggcgtcaaagaggatgcggggcgtgcagggaaatctcatgttaaatattcacaaaaaaccaacggcttttttggcgtagagcaccgctgaaagggccgtttgtcattgtatccacctgttttttatgttaaaataaagttgtatcgttttataatcaggaaaacgcttgtggaattttccagtatgccgccgctcttttaacctgcaaaaacaagcgcgggcctttggcggataagctgttttccattgacaatatctgatggaaaggcgtgatcaatcagcatggcaaaacgggtttttttaattgttcttgacagcgtcggcatcggcgaggagccagatgccgctgattacggcgacgttggcagcaatacgcttcgtacctgctggcgctccggaaatctgcatgtgcccaatctgcaaaagctggggctttttaacatcgaaggcgttggctgcggcgaggcggtcagcgcgccgattggttcattcgcacgtatgcaggaatcgtcggccggaaaggatacgaccatcggacactgggagattgcggggctgatctcaaaaaagccgatgccgacctatcccgacggcttcccgccggagattatctcggagtttgagcgccgcacaggacgccgggtgctctgtaacaagccctattccggcaccgatgtcatccgcgactacggccgcgagcatgtaaaaacaggcgcactgatcgtctatacaagcgccgacagcgtattccaggtggcggcgcatgagagcgtcgttccgatcgaggagctttataaggactgtgaaatcgcccgcgaaatcctgcacggagaacacggcgtcggccgcgtgatcgcgcgtccgtttgaaggcgaatacccctacaagcgcacctcgaaccgccacgatttttcgctccagccgccgcgcgacacggttgttgacaagcttttgcaggccggtctggataccatcggcgtcggaaaaatttatgatatcttcgccggccgcggcatctccaggacaagccgcactgtcaacaatgacgacgggatggaccaaacaatcgcgcatgcgcgctccgatttccacgggctttgctttgtcaacctcgttgactttgacatggtatatggccaccgcaacgacatcccgggctatacggccgcgctcaaccgctttgacgagcgtctcggcgaattgatgccgctgctcggtccggacgatgtgctgatgatcacagccgaccacggctgcgatccgggtacggcgtcgaccgaccattcgcgcgaatatgtgccgctgctcatttacggcgcgtccatacgcgcgggcgtcgacctgggcacgcggccgacctttgccgacacgggcgaaacagccgccgcgctgctcggcgtcaaggctggctgcgacggcgtgtcgctctgcggccagattctgcggtaactacagatgaaatagggagggcttgcaattatgcgcatgtacgatatcattatgaataaacgaaacggcggcgtgctgtcagacgaggaaattgcattcttcatcgacggctatacgaacggtcatatcccggactatcaggcgtcggcgcttttgatggcaatttggtttaacggcatgaacgagcatgaaaccgcggttttgacagactgcatggcgcgctccggcgatatggtcgacctgtcggccattcccggaatcaaggtggataagcacagcaccggcggcgtcggcgacaagacgacgcttgtcatcgcgccgattgtcgcggcgtgcggcgtgccggtcgcaaagatgagcggccgcggtctgggccacacgggcggcaccatcgacaagctcgagtcgatccccggctttcgcgtatctgttgcacaggagcagtttttccagattgttcgcgacgcgggtctatccgtcatcggtcagacaggcaacatcgcccccgccgacaaaaagctgtatgcgctgcgcgacgtgaccgccacggttgacagcctgccgctgatcgcctcgtcgatcatgagcaaaaagctcgccgccggctcgaacgcgattgtgcttgacgtcaagacgggcagcggcgcgtttatgaaaacgctcgacgattcgatcgggctggcgcaggcaatggtttccatcggcgagcgcaacggacggcgaaccatcgcgctgatcaccgatatggacctgccgctcggccatgcgatcggcaattccctcgaggtggccgaatcggtcgcgacgctgaaggggcatggtcctgccgatctgaccgaggtctgccttcagctcgcggcgaacatgctttatctggcggacaagggcacgctcgacgaatgccgcaggctcgccgaggacgcgctttcgagcggcgcggctcttgaaaagctgcgcgcgatggtcattgcgcagggcggcgacgtttccgtgatcgacgacacttccaaattcccgcaggccccggtcacatatgaagtcaagtcgccctcagacggctacatcacgcacatggagacggaaaagtgcggcattgcgtccgtcgcgctcggtgcgggccgtgagagcaaggaggacgatatcgacatgagcgcgggcgttgtgcttgtgaagaaaacgggcgacaaggtcacgcgcggcgagacgatcgcgcgcctttacacggcaaagcagtccgcgctcccagaggccgaacgcctcctgctcgacgccatcaccttctccgacaagcagcccgcccctgaaaagctcatactcgcgcgcgtctccaaggattccgtcgaacgcttctgattctcccgcttttttgaaaaaaggcctcggcgaaaaactttagtcggctgcgccccccgcttttttgaaaaaaagctcggcaaaaaactttagtcggctgcgccgcaaacagtggggcagccgctgcgtaatcaggttttgtgccgcggcgaataaaagttttcgtccgcctttttcaaaaggcggcgggtgagaaaaaaggtaaggcccctcgcgggtcttgccttttttcgagggcagcgcccttatcctgggccgcagccctcataaaagcgcggcccgcaggccgcaagacacctattcagaagcgggacctttcgccagcaggagaagtgacagacgccgcgcggctggcgcgcatcctgcaagctccaactgtttagaaagccccagtaaaaaaccttccgccttttctttaaaaaggcggaaggtttttcgatgcatttatttcccaaaaaggcggagggtcagatacgctccaagttttgctcgcgggacggacctacgccgaccatcgtaatcgggcattcacacaggcgctccagctctgcgatatacttcttgcaggactcgggcaactcgtcgaaactgcggcagccggacaggtcgccgtcaaacccatcaagctcctcatagaccggggaacactcggcaagctcctcgatggtggcggggaaatcgcgcaggatcgtcccgtctgatttgcggtaagccgtacacaccttgagcggacccattccagaaagcgtatcgatcttgttgatcgccagcgcggtcaggccgttgatacgcacggaatggcgcatgattaccgcgtcgaaccagccgcagcggcgcggacggcctgtaactgtgccgaactcatggccacggttgcgtatttcatccccggtttcgtcgagcagctccgttggaaagggaccggcgccgacgcgcgtcgtatacgctttggccgcgccgacaacctcgtcgatcagcgtgggaccgacaccgctgccaacgcatacgccgcccgaaacagggtgtgaacttgtaacaaacggataagttccgtaatcgatatcgagcagcgtgccctgcgcgccttcgaacaggacctccttattctcacggatggcacggtatgcgagtacggaaacatccgcggcatactgcgccagacgtttcccatagactgtgtattctgcaatgaccgcgtcgagatcaagcggctggccgccataatagccggtaatcaggcggtttttcaattcgccggcggcccgcgccttttgcgcgaacaaatccggatggatcaggtcataaatgcgcagtccggagcgttcagccttatccatataacagggaccaattcctttttttgtcgtgccgatctcgcccttgccgcgcattttctcgctcagaccgtcgatctccagatgccacggcatgataacatgcgcgcgcggatcgatacgcaggtttttacaggaaactccccgcgcttcaaggccgtcgatctctcccaggatacctttggggttgatgacaacgccgctgccaagcaggcagagcgtgtccggatagaggatgccggacgggatcagctggagcttgtagacctcgcccccgttttcgaccgtatggccggcattgttgccgccctgcgaccgcacgactacgtcggcgcgcgacgcgaggatgtcgatgattttgcctttgccctcgtcgccccactggacgccgacaaccactctagctggcatatatagcccccccaatgaatttttacaaaaaaatccagtccctttgaaccgttgttaagtatagcaaatttgcagacaaaatgcaatgttgatttttgtaatttacttttatccaaaagtcaagcgtctgcgcgaaaaaagaaatcctcacgccttacccgccgtgatcctccttgatctcgcccgttttataggccagaagcagccacttgaggtcctcgatattgcggctgagctgcgcgccgatatctgtctccccaattttgatacgcgactgcatccgttcaaatacgactgatgtggatacaatatcccggttattgcgtattgcgtcaagccggccgtcaaacggctcatgcgatgccagccgaatgccccaggaattataaatcagcgtgtagccggcaatacctgttgtcggctggtaagcccggcagaaaccgccgtcaatcacaatgagccggcccccggccttaaccggattttcgccctcctttgtcttaacaggcacatggccgtttataatgtggcagtgcggcccttccaatccgaattcacgcaaaatgcgcacgcagacgtccgcgtcgttatagtaagcataataagcgttttttggctcggcccatgcggcatgatcggcgatcaggcagcgttcaaaggtcgcaatatggtcgcgtccaaacagcggggagttgcgtccgcaccagagaaaccataaaaagtccttgccgaattgtttttccggcgtgccttcccgcgcataatagccctgacgcgccagcagatcagcacggtcgagaaacgcccggccgctgacaggcgcgccgccgatggaaaacgacataaacgatccgtccgcttccattggtatacatccgtggaacagcaggtttccattgtagcacttgtacagcccgcccttggaatagaggaaacgcgcgtgcttttgcagcttctcactgtgtaaaaatgcgtcgcgaagctgctccattaaccgctcctcctccttggacagcatatacggagcagccgggtcaaccgttggaaagtctgtgtgcacaagctgatattcgctgccatcgatttggatggtcccgcgcttataatcgatcctatcgagcagcaggcggtcgtccatcccgaattccggattgcgcctgataatctgcccctccagtttaaagaggatgattgcaatcgctttgtgcatccgcgcgccaagctcgatgtccttggcgttgtaggcgatggcgtcgcccaatattttcgtctgaaagcacgaggtgtcggaatcccgataaacctcattggcaaacagcgcaagcggacgcaggctgatgccgtagcctgtttcaatgacttcaagattattataggtgatcgaattgttcagcacggccgcgatgcaggtgcggctgcccgtcgcggcgcccatccacagcacgtcatggtttccccactgaatatcgacggaatgatgctccatcagggaatcaagaatgatatcggcgcgcggcccgcggtcaaaaatatcgccgacaatatgcagatggtcgacaacaagcgttttgatcacaccgcatacagcttcaataaaatcctcggcgcggtcgatgtgaataatggtagaaatgatattttcatagtagtccttcttattatggacctcgtaattggtattgagcagctcgtcgataatatatgcatactccggcggcagcgccttgcgcaccttggaacgcgtgtatttcgatgtgacgagccggcagatctcaatcaggcggtgcagcgtcagcttataccattcgttaagatcctccacgctctcgcgcatttcatccagcttctctctgggatagtagatcagggttgccagccgcgcgcggtcgtcgcgcgacatcacgttttcaaacagggcatccaccttttcgcgcaccgccccggaggcgctgttgaggatatgtaaaaacgcctcgtattcgccatgcaggtcagacatgaaatgctctgtgccctttggcaaatttaaaattgcctggagattgataatctcgctgcttgccgcctgcacggtggggtattgcctggccagcagccgcagatagcgcaaatccgcctcgcggttcgttgtggcttgtgcctgcatcgtgttccctccaatattttgatacggatgacagcgcattctatccgtctggaatacgctgccgctccggccataaaacggataataaccgctatgcggttatggagccatgccgctgcgcggccttggctgcattggccattggggcggcagcgggccgtgcccgcgtatcgccccggccataaagcggataataaccgctatgcggttattatcccagaaaacgcgtgcatttgcaatgtgtacgccgcacaaagacgcccggccgcacaaaagcacgggccgagcgtccttgtcagatcgctatgatttttccggcaggccgatctttacaagacagccctttacagcgccggaggcgtctgtgtattccattgcgcacaccattgtgtcagggttatagccgatcaggtcgctgaacaccgtttgcaggactatgttgcccttgcggtcgatcatgcagatttttccatccttctggacaaatgcaacatttttgcctttgataaaggcgtctgcattgtcgtactgcgcgtcgatcagcagacggccgcggtcgtccgcatatccccacttgcccgatggagtgagcaccaggttatatttttcaccgtcctgccccggcacaataaaatggtcggacgggataatcacacgcccgtcgccctccacaatcgaactagaatacggaccgtcgccgccattgattagataataccccttgtccagattcgcgccgtcggttaaaacctcaccgtcgtaacgggccggaacaatttcgttgccgttgcggtcaatgacgccgtagcggccgcctttttcaaagcaggcatatccataatcgccaaaccctgaaacataatcatataccggatcaattgacatcttgccgctgtcgatatctgtaatcgcgccccaacggccattcttgctgacgcttacgctgccgtcataaagatacagctcctcccactcgggcttgatgacttccacgcctttgtaattgatgacgccgtattttccgtttttcacaacagtcgcgtaatcgccggtaaacgatccgatgctttcatacacaggatcggtcagcattttgccgtctgtatcgcacaaggcccatacgccgttcatctgcaccgccagcaggtcgcgccctgaataatttggcgagccgctccaggagacgatctgcatatcctcaaccgcaaaattctgtaccggctggtattccttcgaataaatacgcagcattccatccttaaacaggatatggcgtttgcccagcacatagaagtcgtcgccgcgctcaaatgaatagtgtgaattgccgtcgcggtcgatgatttcgtattgatcccctttctgcacctgtatcaatccgccgccgtcgccgcccgccgaccagacgtcgtcatattcaaacggcgcgagctgcgtgccgtccgacatatcaatcgcaccggttttgccgtcgagcgtcagcgggattaccccatgaaaggtattccacccctccagcgcagatgtataaagcggctctgtcaacagcttgccattggcgttggccactgcaagctttccattctgcccaaggaaaaagaactcgcacgtttgaaagccacggaatccgccgcggttgagcgggaaattcagatcatattgcgcgggcgtcagcgcctcggccgtgtagccgtccgcggctatttccacgattgattccggcagcgtgatcgctccggccgtagcctgcggcggcgtatccggctgcggcgcgctggcaggcggctgcgaggactgagacgcgctggcaggcggcgcttcctgcggcgcctgctctgacgcgccgggtgccgtcgcctccggcgccgcgcccgcgacagacgaagcgcccggctgcaccggcgcgcttgccgggaccgccggctggcagcctgccagcagcagggcggcggcgagcaaaatagcagcttgttttttcatggttatgcttcccttccggggcaaaccgcccctctgtatatacagtgtcccatttcctccaatttcttccccgctttccggcctttttgaaaaaaggcctcagcgaaaaactttaatcggctgcgcgccggcctttttgaaaaaaggcctcggcgaaaaactttaatcggctgcgccgcgaacagtgggtttggcgctgcgttgatacaggctgcgccgtgaacagccggtttggcgctgcgttgatacaggctgcgccgcgaacagccggtttggcgctgcgtaatcaggttttacgcggcataatctgtcaaaaatctttgagcgtttcgccgatgggcgcctgaatcagcagatccgcgcctgcgtcgagcggcgtgggcgacatattgatgacggcaaggcggcctttgcagtagcgcacaagccccgcggccggataaacggccagggaagtgccgccgacgatcaaaagatccgcctgggagagcgcctcgaccgcacccatgagcaccgtctcgtcgagctgctcctcatagagcacaacgtcgggcttgatcgtgccgccacaggaacagaccggcacgcccggtgcgtccagaaccgcgtgtaaatcgtaaaattttccgcagcgcatacaatggttgcggtgaaccgagccgtgcagctccagcacatttttgctgcccgcggcttgatgcaggccgtcgatgttctgcgtgacgacagccgtcagctttccttccgactccagatgcgctagggctttatgcgccgcattcgggcgcgcgtcgggcgcgagcattttctcccggtaaaatgcaaagaactcctcagggcgctccatgaaaaaggtatggctgacaattgtttccggcggataacgccatttttgtctgtaaagtccatccgcgctgcgaaagtccggaatgccgctttctgttgacacacccgctcctccaaagaaaacaatccggcggctttcgccaatcatgcgcttgagggcttcgttttgttccatactgaaaactcctttcgctgtacatcaattccaccagcttttcagggtattcatccacataaaattggttcattttcacatatagggcttgcatttttggaaaattatgctatacttattgtagtatcggacaggtaacaatcgcgcttacttctctcttccacactcttatatagtgaaacaagcgggctgcgtcgcaacggcccgcttgtttccgttttattgactttttttccgatcagcgcgccgcgtgcggatctccgcctttacttccgcgccgacacggtttgagtcaagcagcttctgcgcggccatacgcagagtctgttcatccagccgcccgctttccagcagaacggctgtccgccgcggaaatttaataaaacagaccgacagcgcccaagccacgcccattttgacataatagccttcatgatgcactccggccaaccattccaaaacacggtcgatatacgcttcgtcgataaaatggtccatcagcatcacaacgccgaaacgcacgtcgaattcacgcggcgcagacagatacggcgtcaaaaaaccggctgcctgttcccggcatttgcccacggcgcgcagaccgccgcaggtaacgtcgcagacagcccaattgtcaatgtgcggcacaaacgccgccaaacgcgcaaacagctcgttctgctccatccttgcacagccgagcacaagtccctggagcatcgtctcctcataggtgtcgtggcgcgccgcctcaagataaccgcgccaatcgccgcgaaccagctcgcgcgcgagctggcgcagcgccgggacacgcacgccgagcaggtttgtcacatcaggcaccagtttttgctgaaacgcctgataggccggatccgccaacgatcggaggcgcgcctgcagggcctcgtaatcctgtggagtcatcgtcttttcctctcctttggggccgtcagatcataactgtgggcgatcatgccgtcgagcgcatcgtcgtccagtcccgcgttcagcgtcactgtgttccaatgcgtcttgttcatatggtagccgggcgccacctgaggatacacctgccgccagaactgagcctgcatcggctcacatttgagattcaggcacaatttcccgtcacgttcaaaaacaagcgcgtaacagcgccggttcgcgcatcggcgcaccgccgtccagttcgggtcctcaaacggctgatcctcataaacatccggaaagcataagcagcgctccaacagctcccgccgtgtcacagcctacgcctcgtattccattttttccggcgtccagtctgtgaggaccgcctgcatttcctccgcggctttgcgcgcgcccgcaagatcgtgctcgcggtaatttccgcattccgcctcggccgcgccggggatctcgccctcatacgacgcgataaaagcgaacgtctgcttgagcagatcgatcacctcctgcctggaaatgctgtcgcgcgtcagaaaataaaagcctgtacggcagcccatcggccccacatagatgatgcggtcgccataggacgtgttgcgcacgtacgtcgcgaataaatgctcatacgtgtgcagcacgccattggaaagataactgccggcgtttggtctgcgcatacggatgtcgtatgtaacaacatcgccgtcgacgcgcgagacataaagtccaggtttcagtttggtgtgatcgacggaaaagcttgcaattcgttccattgataatcagtcctccaaatacggcaggatgacccggtatgcctcgcacagccggtcgaacgaacaggcgcagttggccgggcttgtcgacggcagggcggcggccgggatgcctgtcgcagattttatatacttttcgtatagatcaaatgccttttttccagttgtaaaaatcgcacgaatatcgcccgcgcgcagaatcggggaaaggtcgtttggctttgggtctttaatcgacgcgtcgcttgcgccggtaatcccgcacgattgcagcacgtcccacagcgcgatgcgccggcttaacatcagggcggctttttcttcgttcgaacgcggcgcaggtacgtccaaaacagccgccatcacgcgccagaaacggttttgcggatggccgtaaaagaagccggacgcgcgcgatttgggcgacggaaaggtgccgagcagcagcacgcgcgagcgcgcgtcatagaccggcgcaatcgtatggacaagccgcgcggcggacgcgccagacggcatagcgccgctcacggttttttcgcagcggcttccagcagcatggagagcgcgtgcgacgcggcaatatagcggatataatcgcgctcgcccgtctcaatcccgcgtccgagacgaagctctttcacatcgctgtaccactcgctgctcaccgccacgtacaccagccccaccggcttttcttcggtgccgccgccgggtccggcgacgccggttgtcgaaacgccgatatcagccccggccagccgccggacgccgtcggccatttcacgcgccgtctgttctgagacagcgccataccgcgcaagcgtctcgcgcgcgacgccgagcacgcgttccttgatctcgttggcataacttgtaacgccgcagtcgaaaacggccgagcagccgggcacatcggtcagccgcttggatacatagccgcccgtgcagctttcagcacaggccgcctttaaacccttctccgtgagcgcgcgcacagcggccgtctgcaaatcgcccacatcgacgccataaatatactgcgaaaaacgctcgcaaagcgactgcacaacaggcgcggtcatctcctccgcctcctgctttgtatgcgcgcgggctgtgacgcgcagcatcacctcgccgtccttggcatacggcgcgagcgtcgggttctccatccgctccatctcatcgcgcagctgcgcttcgagcgcgctttcgccgatgccgaaaaagtgaatgctgtgcgatacaagcacatgatcggagcggcgagccagatagggcatgacctgctcgcggaacatcggcagcatctcgcgcggaggacctggcagcatgatcgcggttttcccgccgccctccacaatcgcgcccggagcggtgccgttgtggttttccagaacgatacagccgcgcggcatcatcgcctgtttgaggttgttttccgtcatctggcggcccaccttatggaaataacagtgcaggtgcctggaggacggctcgtgcagctccagcggcacgccgaaataaccggcgatcgtttccttgcttaaatcgtcgtaggtcggcccaaggccgcctgtcgtaatcacaatggagctgcgttcaaacgccgcggcgagcgcctcgcgcaggcgctcgggattgtccccgacaaccgtgtgccggtagacgccgacgccaagctccgcaagcccgcaggaaatctcccgcgaattggtgttgacaatgtttccaagcagaatctctgtgccgatgcacaaaatttcagcagaagcgttcactggaatcaggcctttcaattgataaaatcgggacatatgcacagcagagctgtttgctccgccgttatggcgccgcggcggccagtcccttcgggcttgtctgccgcgaagcggcatggtataattgcccatcaaaaggcggttgccgcgcaagcggcgagccgctgggcataacccggtaattgacggaactgtccgtccggcttaatgaggcgctagcgactatcgcggcactcaaggaaaaaccggcgaaacggggggagagcattgccgacaaagcgatatgggccgtgctcgcggcggtgatcgcctttgtactgggacggatggggctgtaagactggaggagcacaaatgaaaatcaattggaaggtacgcattaaaaacccgttgtggtgggttcagatagaggcggcgctggtactgccggtgctcgcatacttcggcctggcctgggaagatatgacctcctggggcgcgctgcgggatgtgtttctgcgcgcggtgcagaatcccgttgtgctacttgctgcggcagccagcgtgtttaacgctgtgaccgacccgacaacggccggcgttggggacagcaggcgggcgcttgagtataagacgccgaatcgtgacgaataaaggcgatcaatgcggattacggcttgtaaaaaagggcggcgcatggtaaaataatgctggcgctgtcgcaaacggcaggcggttagtcactcccttgcgaaagggggtgttatgtatggttgagttgttgctcgcgattttattggtcgtggcgatcacagaagccgtgaaatacataaaaaaatgaccgcccaaccctgcaaaagttagcggtcataccgtaatttgtaagggctaaccgtctgtcggcagcgcctctttgttttcattatatccgtaccggagatatctgtcaagccgctggcctttggcctgcggcttattgattggaagccacgggaatgctttgacagaagggcgtcaataattgagcgggcgtcatgccagttccacggctgatgcgatcaaggattttcaaatttgtatgcccctctgcgcgttcgattcttgcataggttttgacttcaataccgatttgaagcgccagatcttcctgactgagtccattgattgcgcggtattcaaaaaggttacatgccaatataactctgcattcatcgtacttcacaattatttcctcccgcttcgttttatacgatttatggaaataattgtataagtcagtcgtattttgtcgcaagagtgctaagacccttgacaagcttgtttaaatatgtattaaacatccaaaacagggtggcatatgccaccctgtaaatctgatatcttgtttattattgcgcttttttaagctctgtgatctgtgcagtatgagtttttacagtaccttccaaggtactcacgcggcctttcaggctgtcgacctccttggagacagacagcttttcaataatttcgctgtgctgctcggcgatcagttgaattttggggacaacagccgtttcgattatggcgtttacttgattgatgattcgtttttcttgttgctctatcatctgatataaatgttgattatcctgttccactttatcaagacgttcattagtggttttttgcccggcctcaaggtttttttgcccggcttcaaggtttttttgcccggcttcaagggctttttgcccggcttcaagggctttttgcccggccttaagctcttttaattctgctaagatttgatgcaacagctcattttccacacgatcaacccctcttttctactatagcatatccagagatagacatcaaggcttgggttcatcttccgggacgtaaaacaagtgtaaaattaattgaaaaaatactaatatccgtgctgcaatataatcgcaggttgcgggaaggcagacggaaagaagcgaaagcctaaccaagaaggcagcgtaaagccgggaacggcgcggaatacggttccacaaagcccccggctctcaaccagtagcaagggagagagcaaccaaagaaaggaggggttgcgaatgaagtttagagactttcagcgactgaccccgccagagcgaaaagtttactgggaatcatataaaaagcggctgactggcgcaacagtcaaccgcaaaaccgcaaggccagcccctagcaaaagcctctaccttgctacctccattataccgaaaagcaaagaaaacgcaaacggaggtatttttatctggacatcatcaatagatctgaggagatacacatgcaatttgtgaaggaaatcatccggctgttgggttcggccaccccgaaaagcagaaattgatattggcatttattaaagcgttagtttggggagaacatacaggttagaaattatcctaaatattgcacaaatttttaggtaaattaattttttggtttagaaaataataacaatatagatacataagaattgatatttcttcgtatcagggagaaaatgattttgagagggtgaaggcggacggcggacgcctgcgcccgacctatccggtgcacatggaccaggaatacggctctccctgcggtaacgcctggggagtgggaaggaaaagcagcttcgtaccgatacagccaaggtgtttctgaaggttctggaggacgccggatgctatgccgggctttgtagggcgtgtggacggcatttccgtatcgatggatatcaacgcctgttaccgggattacccggagatcattcggacaaatctgctcaacggctggaaaagtgcggacaagccagatgcgccaaccaatccgttcggtgataggatactgtccgtgtccacagcggaactgacagacttacgcgatagtttatcggtagttctctcgatgattacagagatgttaaaagctacataatattgtgaaaataataaaaaagccgccaaaagggagcgatcctggttgtaggatccgcaagtttctacaacacgttcagtgaatctataacattatattcccatacacttatcaacctaatgtgaccccaaataatggatggattgcgcatatgatggatgtcttgaataccggagcggcggaaatcaccgagtgggacgagagcataatccgtcagctggtggatacggtgacggtgctgtctgaggacagaagccatgtccgactgtatgacggcatgagttcgaacaagaactaggcaaggagagaagctgatatggtttacgtaaccggagacacccacggcaacttcaaacggttttgaaaaacctgcttccccgaacaggcaggcatgaccaaagaggactatcggcagcgaccgacaggatcgtgaggcacgccgcatatgcgagtttgagacgtaaaagtgggcgttgaaaaagcagctttcagcaaaagaagatgtgatcggtatcttaaaaaaatccgtcggtatcctgtccaaaccatagagaaaaagtagagccgtacccaaactcttagttatcagggagcctctgtggagcaggcattccgggtattggaaatctcacgcagcgggtactatgactggcgcaaacgctcccgggcgtatcccgccagaccgtgagcgaccaactacagatttgcgcggaagacgcgctctttcagtgctcccaacataatcagtctccatcttctatgtaggcctgcatatcgggccacaggtcgtccagacactggatggccttctgatacaagttgtactttttgtcataagccttggcagcttcgggatcggggtatatgggggcggacaggcggcacatggcagcagctgccttggtgggggtggcgtagtcgcccaatgcggtggcaacagccacagagcagcccagagcgccggtctcgtcagcggtcacggtttccacggggcagttcattacatccgcgaaaatccgggtccagaccggggagcgggctgcgccgcctgccagacggatgcggcacgggtggccgtcgcgggtatccagcagcttttccaggtgatggcgatgagagaaggcaatgccttcataaactgcccgaagcatgtgcttacggctatgggaggcgttcaggccgataaaggcagcgcgggcccgggggtctacgttgctggcggtgaggaagggcagaaagatgggcatgaaatcggcggcggagaactcctcagcccactgattcatcagagcgtaaatgctcttggactgcgcttttgcctcctgcaccagctcgggcagcagctgctggataaaccactcgttgttgccggcggatgtggggctggattcttcgatgagatagtactccggcaggcagaacagggaattcatgagaacgcggccgtcggtgacgggttcgcggcgaatgtattcgttgatgctccaggttccggcgatcatgcagatgtgctcctcgtccgtcacgttgacggccagagcgcaggcgtcgatatcaaacataccgccgatgacgggagtgccctctgccaggccggtggcctgcgcggcttcagcggtaatgcggccggcgatctccagagaattgcacagtggcggcagagcggacgcaattgcctcaatgccgaacagcttgagcaaggcggggtcaaaagacttggtgtgcagattcatcaggccgctgccggaataatcggtgacctcagcgcgggcctcaccggtaagacggaagcggacgtaatccttgcaggcaaagacccacttgatattttccagaacgccaggctcgtgatcccgcagccaggccagcaaagccaccggctggcaggccattacgtgctggcaggacaaggcaaaggcggccttttccgtgccgtcagttctccagtccatctggtatttccaggcgcggttatccgcggagagaataccccggcgtacgggctgttcgtctttaccccacaggtacagacctttgccgtggccgcacaggccaatgccggcgatcttcctggagttgatgccggttttttccagaagtgcccggatgacacggcagttatcctgccacatatcgtccatatcccgttccacaaagccgggggcgggggtgatagcatcggtagcggcagcctccacgccgatctgccggccttcggtgtcaaagagggcggctttcgtgctggtgccgccgttgtccagtcccaaataatatcgcatgtattattcctccattgccagagcaaattgctgttcgatataggatttggcggccaagatgtcctgcttccagccctggtcaggcttctaccacatttccatcatatagggacggtgatagccctgacgttccagctggcgcaggcacaggggaaagtccacgcatccgctgccaaaggggacacatttgaacttaccggggaagttaggtgtgacggccagggtatccttcagatgaacggctgcgatctccttgcccccagcgtcaactcagacgccacatcgctgccccaggcggtcaggttgcccaggtcggggtagacagtgaaccagggggtgggcagatcggcttttaaggctttgtagcgggtgatgctgctcatgaggggggtgtccatgatctccatggacagcatgacctgatatttctccgccagcgcacagacggaggccagacctttaatcccagcaagtgatctcctgacatagtagaaacgctcctttatgtataaatgtgaggggatcgcaatcagtcgggaagcagaaggggatgggggcggacgggatgggccggaatggtactgccgcgaacattcaactgggtcccgaccaccattttgcagggggtggtgcagaggccgttgatggtgttcagcaggatctgcatggcccaatacccgatgtcctcgcaggagacatttacggtagtgagcggcggatccgccagagcggaaaatggaagcccgtcaaagccgacaatggaaatgtcttcggggacccgcagaccgaagtctttcaaggcccgcatcgccccgatggctatgctgtcattattggcaacaatggcggagggaagcgcgacgccggcctccagaagttccctggtggagcggtaggcgccttccattgtggggaacacaggaaagaccagccgcgtgtcaaagggtaggcccagatggtgcatggcgttctgaaaagcggcgcgccgttcctgatcgttactggcgggaagggaattataaaaaaacccgatttttttgtagccaagttgtgccaggtgctccacaacggaaaagatcgcctgctgattatccatggtcacgctgctgaccggaaggcaagacagagagttgtccaccaccagcagcggcttttccagggggaggaagggagccatatcgttgggaatcaactctgtaccgaggaaaatggtgccctttatggcgggttttccgatcaattccttaagagcggcactggacagtgaggcatcgatagtcaccacctgaaggtcgtacccggacttgcggcattcctgctccacggcgtccatgatctgggtcacaaagccggggttgccgttgaccagatgcgcgtggcggagatacttgagaaagcagatgctgcggttgcttttgctttttccctctacatcgtagccgttttggcgcaaaaggtccttcacgcgttcacgggtctcggagctgatgccgggctttccgttcaggacaagggataccgtggtaagtgatacgccggcttgtttggctatttcgcgcagattcatgcaacaccctctccttgggattttagtaaacaattaaaaaatcagaaaatataaacaaaaaatatttaaaattatattaacacatttaaaaaagaatgcaagagtgggggcgagaaaaaacggggactgtttttgcgcaaaagtgtgaaaagcagtaaaaattaagaaaaacagacaagcatttggtcagaagttcggaaaatttgactgtaatatagaaaaatatataaaaaaattatataaacttccgaattgacttattgaaacatcatgctatgattaaaacaataaatcttttatattgggatggagctatcggtgtttagtaaacaacgatagctgagaagatagattgggtatccgcagaaaaaggaggtcgttatgtcattatgaagaagatcttagcgatgatgctggctctggttatggctctgagcttggccgcctgtggtggccctgcagggaattcccccgcaaccgagaagcccggcgccgagacgagtgcttccgtcaacgagggcggcctgccctacgaaggccatacgctgtacgttgccaactggcagggttacaactccgaccaggcctattgcgagaaggcctttgaggatgctactggcgcgcaggtggagcatgtttattttaactcttatgacgaactgatgacaacgctgctgaccggcggcaataagaccattgacgcagttgttctgtcaaacaactacacccaatggttccacgacgatggcctgatctctgacctggatgcctccaagctgcccaactatgagaagatcgccgacgtttacaaggaccaggccccctatgctgtggatgatgcaggcagcctgttcgcagtgccttggtgcagtggcacatcttccatcgcttataaccccgactatgttgatttcgagatcgagcactggagcgacctgctggatccccgtctgaagggccatgtcatggttctgaacggcgacggcgattcctgggtcatcggctgcctgctggccggcgaagattccaacgatatcgagaacgccgacatcgaaaaggtccgcgcctccctgaacgagctgaagggtcagctgctgggcttctggagtaccaacgacgaacagatcatgccctggatggccggtgacttctgggccggtgagatctggtccggtccctacagccagttgctgcacgattccagcaccaatatcaagctggtccaccccgaagagggtaccgttggcttcatcgactactgggccatcgtggaaggcaccgacgagcaggatctggcttacgagtggctcgactggatcatgagcgccgaacagcagacctccatggctaccggcatcagcgaagcttatcccggtgagtacatgacttacacgcccgtcaacgcggaagttatcgaggcgttgactcccgagcagaagatcgatctgcagctggatcccatgcccaccaccatcaagctgctgccctacatcgccgatccggcggtgaaggatcagtgggtcgacctgtatcaggagtttgtcagctgatataagatcatatcattcgcagaattcatcaatagttctgacagaatgccgccggaacccctttcggcggcatttcctttaaaaaaaccggggggtggcaaatttaaatgagtagtttgagtaaaaagaaattccagctcgtgacactatggacagcgcccagtatcgttttgctgctgtgcctgacaatcgttcctttggtgatgctgctggtgttcagctttatgaaccggaatatttttgccggtgagccttggccaggttggaccatgaacaaccttacccgtatgatcgagtccaatacgttctggcgcctgttgggcaagtccctgatgacggcgctgaaggtgacgctcatatgcattgtggcggcctatcccacggcctgggccattgccaagatcgtgaagccgaaaaaccgcagtattttcatgatggtagtcattctgccgtttttcacctcccagctactgctgatctacgccatgatgaacctaatccagtccggcggtctgctgctgaccttcttggacgccatcggtttccataacgtccccaccatgctgtataccaacaaggcgaccattctgatcctgacatacgaatatctgccttatatgatcctatgcctgtactcctctttggagggcattggcgataacctgatccaggcttccctgatcctgggcgccaacaagtggaagaccttcaccaacatcgtgtttcccatgagcgttcccggcctgctgtccggcgttctgctggtgttcgttcccgtggcgggcagctttatggaacccggcctggttggcggcgccaacggcgcgatggtcggcagtatgatcgatacgcagtattccggatcgctgaatatgggctatggcgcggtcctgtcctgtacgctgctgatcgtcctcagtattattatgggactggttcgtctggcgactgccagggcacagaaggcaatcggaggtgacgtggaatgaattccaagggttttaaccgcgccatggtggcgtgcctgtggatcgtattggcattcatgtacatccccatcatcgctattattggcatgtcttttaatgccacgccctatggtatgttcccttatgtctttacctttgactggtacaagatcctgtttacggagagcaacctgctgcccgcctgcgtgttcagcctgaagtttgccttcggcgtgacggtggcggcgatcattattggcacaatggcttcctttggcttgcaggcctactcccccaagtggtcaaatcgtctcaatgcgttgatccagctgcccatcatcatcccctggctggtgactgctatctccctgctgctgctgttctcctttatcggtgcgggccgtagcatggtttccatgttcttcggtaacctgatcgtggtgctgccctatgtggtgctgctggtcaatggccgttttgtgtccatggaccgcacaccggaatctgccgcacggctgctgggcgccggacctgtccgcgtgttctttgacatcacgctgcccgccatcgtccccggcatcatggccggcggtatcatggcgatgatcatgtgcttcaacagcttcgttatgcagtactacctgatccccatcggaacccagacgctgcccaccctggtttttacccgcatccgtagcggctatcaggcagacctgaacgccctttccgccatcattgttctggtcgcggtcggcattgtgatcctgctggtcaagctgggcttttcggccggaagcctgttcggtatgtcctccggttcgagctctaaaaaaggagaataaatcatggctgagttgagagtaaataatctgaaaaaaagttttggtcagaatgaagtgctcaaaggtgtcagcttccatctggagactggcaagttcctgtccctgctgggtccctccggctgcggcaagaccaccattctgcgtatcatttgcggtctggagaccccgagctccggcgaagtgctggtagacggctcagatatcaccaacgtcaagcccgaaaagcgcaacatcggcctggtgttccagaactacgcactgtttccctccatgaccgtggccaagaacgtgggctatggcctgaagatgcagaaggtcccccagaaggagatcgacgagcgtgtggaagatgctctggagctggtgaagctgcccggctacggtccccgcaagatcacccagatgtccggcggtcagcagcagcgtgtggcgctggcccgcgcactggtgacccgccccagcatcctgctgctggatgagcccctgtccgctctggaccgtaagatccgcggcgagatgcagtatgaaatccgcaacattcagcagaagatcggcaccaccaccgtgttcgttacccacgatcaggaggaggcgctgaccatgtccgaccggatcattctgataaacaagggcagcattgagcaggaaggcgatccctatactatctacagccagcccgctaccgagtttgcttctgacttcctgggcaaggcaaacctgatcagcggcaagctgatgtgcgagaacgataagtggtatctggtgaacaccggtatccgcatccccatcaactactgcggtggcaaggaaggcgacgacatcaaggctgcggttcgcggcgagtacttcgagttctgtaacgaagaggcggaagacgccaatgtcttccgtctgcagagaaagatctttaccggcctgagctggaaactgatcggcctgctgggcgaccagcctctggacatctccgcgctgggcatcagcgcagaccacctgcaggagggcgcgccccagtatgtccgcattcgtcctgagaacgtggtctactataacaactgattttgggggttattgatatgagcaagcactatgaaaccgcccgggagatttatgcctcctggggggtcgataccgaggaagccatccgccgcatggacgagatccctctgtccatcaattgctggcagctggatgacttgacgggctttgaagattttgatgcgcagctgaccggcggcattcaggctaccgggaatgcacccggcaagccccgcagcattgaggagtattttactaatctggacaagatgctgtctctggtccccggcgcaaagcacctggctctgcacagcgtttatcccctgaccaatggcgtgaagatcccccgggatgagcttaggcccgagcattttgctccctggatcgattatgccagggaaaaggggatcggcctggatttcaatcctacctacttctcccatcccatgctcaaggatggctggaccctggccagccctgacaagggcgtccgggacttctggattcagcacggtattgcatgccgtaagatcggcgagtcctttggcaaggcgctgggcgagacctgcatcaccaatcactggatacctgatggctccaaggatacccgcgtggatatgctgggtccccgtgagcgtttgatcgattctctgaatcagatctttgcggagttcatcgaccccaagtacaatcgggactctgttgaggggaaggtttttggcttgggtgtggaaagctatactgtaggttctcacgatttttatgccaactatgtcctgaccaccggtaaggctatggtctgcatggatatcggccactatcaccccactgagagcgtggcggataagctgtcttcctacctcgcattcaaccaggagatcatgacccacctgtcccgcggcgtccgctgggatagcgaccatgtggccgtcgtgtctgaggaaattgttgccatcatgcagcagatcaagcgctgtaacgccttcgacaaggtacatctgggcctggactttttcgatgccagcatcgaccggatcgccgcttccgtgatcggcagccgcagcgtgaaaaagtgcctgatgacggctctgctggagcctactgagcgcctgatgaaggctgaggctcaagaggatctgacccgccgtctggcgctgcaggaggaattcaagatgctgcctgccggtatcgtgttcgacgagtactgtgagcgtcacggcgtcaaggcttccaactggatgggcggtgatttgaaatgagcgagctccgtcgttttatagtagatacagacacaggttccgatgatgtctgggccgtgatcgaggcgctccgggctgtagacgttgttcgggtggaggccatcacggtggtttgcgggaacctgccgctggatctctgcgtgaagaatgccatgcatgcggcggacgctgcgcgcacctatgtgcccccgatttatcggggcatggagcgacccatcatgcgcaagcaggcattttatgcggccgatatccatggggaggatggcctgggcggcatgaatctgcctatgccggagagtcctgtggaaaacaaacatgcggtagacgctatcatcgacatcgtgatggccaattccggcgagatcgagatcgtcacctgcggccctatgacgaatttggccatggcgctgctgaaagaacccaagctggcggaaaatatcaaaaaggtttggatcctgggaggctctgccggcgtgtccggcaatatgacccctactgcggaatacaacgtgtacgtggacccggaagcggccgatatcgttctggacgctggcatggacactgtttgggtcacttgggatacggcggtgggcgaaacggaaattacgcctgaagaagtggagatgctgctgaacagcggttctcacacggcgcaattctgtgttcgctgcacacgtaaactgcgggagtactacctgagtatgtatggccggccttcctatagcgtcattgacagcctggtcatgacggcggcgctgtatccggagatcatggaaggcgtgtttcaagcaaactgcgccgtggagagaataggaacggagacgcggggatatttccgcatcgaccgtgacaaccgcttgaagcgatctcccaacgcggcgatttgtccggcggtgaatgtcccgctctacaaaaaacacttatttgcattgttgggcgccggctaagtgaaccgactggctccgctcaggcggagccagtactgctaggattgaaaaaggagggcctcatcatgaatgactttagattttataaccctgtccggattcattttggacagagctctctgaacaagttgccgaaggaactggcggctgtgggtaagacggtcctgctggcctatggcggcggcagtattaagcgtaccggcctgtataaccgtgtgatggccattttggaggactgcggcaaggaagttgtggagctgtcaggcatcatgcccaacccccgcaccgaaaaggtctatgagggcattgagttgtgtaaaaagaacaacgtggactttatcctggctgttggcggcggcagcaccattgactgtagcaaggccatcgccgtgggcgcctgcaccgaccgtgatttctgggaggcattttatctgaacaatgaggctgccgaagcagccattcctctgggcgtggtgctgaccatccctgctaccggcagtgaaatggatcgctctgccgtcatcacccattgggagaccggcgtaaagaccgactacaactccgacctaatcttccccaagttctccattctggaccccactctgacctatacgctgcccaaaaaccagatgatcaacggcatcgtagataccctgagccatatctgggagctgtatttctccgagcctgataccgacagcgtgacggataatctagcggaagcgctgatgcgcagcgtgattgctgcgacccgtgtcgctatcaaggagcccgaggactatatcgcccggtccaatatcatgtgggccagcaccgtggccctgtgcggcatgataggcaacggcaagaactccgactgggccagtcataacattgagcacgccatttccgcgctgtttgatgtggcccatggtgcgggtctggctgtggtgcatcccacctatatggcgtatttctgccagaatgctccggagcgctatgcccgctatgccgtgaatgtgtggggcgtggaccccaccggcaaaaccgcgctggaagtggcccgcgagggtgtgcagtgcacccgcgacttcttcaacgagattggcgcgcctgctactctgacggatctgggcgtccccgagagcgccattgatgatctggtggcgcacacggacatgggcgcatgggcttataagaagatgacgcaggacgacgtgcgcgccatcttgcgtatggctctgtaaggggggaccgatggaacagatttctgttttcgacagccgcttcgcaccatacggacaggtgctggaaggatatgatttcgcagaacttttacggattatggaagaaacgaccccctgcccggaggatggcacagtctatgtggcatctgtcccggaactggaggtactttctgtggcggcagagctgcgggatcgcggatttggaggtatgcccattcagatcgggtactgcaacggcgccaacacccgcctcagctgtctggagtatcatcgcaccagcgagctggatatcgctgtgagtgacatggtcctgctggtggcccgtcagcccgagatcgtgggcggtgtgttggatactggctgcgtcaaggcgttcttcgtgcccaagggcacagcggtcgaactgtatgccacgaccctccactatgcgcccgcggcggttggccatggattccgcatgggctgtgttctgcccagagggaccaatggggatgcccccaggatcacgcctgtgggaaaagaggactggctgctctggggcgcaaacaagtgggtcatcacaagcgtcaataccgatgaggcgcagcagggcgcctatgtgggcatccagggtccggatgtggacttgatgaagggctgagcgaggagggcaacatgcaggaaaagtggatcgaaaagatctatgccggttttctgggcatggatgcaggtatgcgcctgggcgcaccggtagagaatccctactggacctatgagcgtcttgaggaatactatggaaacatggaaggctatctgcgtgaatatcgacactatgctgctgacgatgatgtcaacggcccggtaattttcttgcgggctctgattgactggggcaaggactttacccccaagcaagcaggcgagacctggctgaactacacgcgctgcggtcacggtatgttctggtggggcggcgaggatatgtccacagagcaccgcgcctatatgaacctgaagcgcggggtatccgccccaaaatccggcagcatcgctctcaacgggcaggtggctgccgagcaaatcggcggtcagatctttgtggatacctggggcctgatctatcccggcgatcctgccatggcagccaagcaggccagaaaggccgcctctgtttcccatgacggcgaaggtctgtatggcgcgcaattcatggcagcctgcgtagctgcggcatttacctgtactacggtagacgaggtgctcgatgccggattggcggtcctgcctcgggattgcgattatcgccgtgtggtggagtctgtgcgggccttccacaagaagcagcctgatgatttccgggcctgccgcaattatgtggatcgggagtggggcacccacaagtaccccggttactgccacatcatccccaatgcgggtatttgcgtgctggcattgctttacggtaagggcgagttgggccgcaccattgagatcgcttgtatgtgcggctttgatacggactgtaatgccagcaacaccggcaccatcaccggcgttcttggggggctggaaaatttccctgcccgttatcgcacgtcaatcaacgactgtgtggtcttgtccagcgtgtccggcttcctgaatatgctggacagcgcagcgttctcgaaggagctggctgttctggcttaccgtctgcggggtgaacaacctcctgcctggttggccttgccccgacccggcgatatgctgatggactttgagatgcccggctctacccacggcctggaattgacagaccgggccagccattggatccgccctgtggagggcgaagcccacaccggtaagcgctgtctggagatgatgatcgacggaaaactgccggttcctgtggatctgttcttccgcggcagctttatgcgctctgacttcaacgatgagcgttatgaaccggtgttctctccccgtgtctatcccggtcagacggtttcctgctggatgaagagtaagcaggaagcgcccgctgccattactgtgacgccgttcctgacaacggcagtaacaggccagcgaaaagagctggagccggtggtgctgccggataggacctggcgccaggtctccttccgggtacccgagcttgcaggcgaccaggtccatttcattggctggaaggtggagatcaaccccacgacgccgccctggacgctgggccgggtctttgtggatgacatcacagtcaccggccccatggcctacgccatcgatatgtccattcagaagaaggagtttgatgagatcacgcccttctcctgcaatgatattcagccggacctacagtatggtgaactggtactgcggacggagtgcggcggacaggcctttaccgggaattattatacccgggatggggccatggaaggcgaagccgttgtggagagtggagattcctgtatgctgcttctgcggggcaagggcacccgtaacttctatgcgcttgggcttgacggcgaaaatgcggtcattgcatgctgtgaaaacggcgaatggacgcagctggcagctgtcccgtatggatggcagcgcggtgaaacgctgcggatccgggcagaggccgaaggcagcaacctgcgcctgctagtagacggcgctttggtgctgcaggcagcagatgatcgctttgcttacggcatggtgggcgtgtgccaccccggcgctgcttccagccgctggaaaatgtttgctgtgaccggccagatataattataaaaattacccgatcggaggatcgggtgatttcaggttttcgaaaaccctgctgcgcatgaagcggcggcagggtttctggcatattagagatagaataggctcaaagaggatatggtggagagagaaattgaacaggcgctgattcaagacattaccaagcagctgctcgaactgggaaccggatttgctttcctggaaaaccaatatcatctgaatgtaggcggcgacgatttttatatcgacctgttgttctataacttaaattttagctgctatgtggtgattgagttgaaaaccggcgagttcaaaccggaatatgcgggacagctcaacttttatctctttgctgttgacggtattttgaaaccggatcaggacaatccatccattgggccgctcccgtgcaaaagtaagaatgacttggtagtggaatattctctgaaggatctgagcaaaccgattggtgtcagcgagtatcgcatcaccatccggttacccgaagaattggagaaacaactgtcttccattgaggacattcaaaaaaggattcgctgatatttttagcagacagcacagagtggttccaaagtgagcaggcttgctaccggacaagagcctggagtcaattcgtgcaccgggatttttcctttttctcaaagctgctgcccgcgcttaacacatagtgttttggcccagtggctgcttttttaaaacgactttgcaggagcagaggagacagcaatatcatgcttaaatttgctgcgatataggccgatctctaaatgtgaggagtcagcaggtccatgacaggcaatccggtcccttgactgagcttgtcgagcgttctaagggaggattgaatttccgcacgttctattttggtgtagccgcttacacttaatccgcttttccaggccaattcctcctgggacagatggttgtcagaacggaaacaaagcagattgtttgccaagatgtcttttgattccacagtgattcctcctcaaggttgttcagacgctataccacgatgcgtacgttcctggattggtacagccttttatgtctattgtaaaagcaagtagaattattatccaggtacgatcggctcttgacaagaaaatttgtacaatataaaggacagattggctcgatcaatagccaaataggaaataaaaaagctttaaaaccgttgaatgaaacgggcgcggcctggttcaagagtgtggaagtccccgacgctaggatttttatcatatgaattaaaaaataaaaataaagagccgccggctacgccggcggctctttatttttgttcagtcctttatgcggatagcgggattgcatgcggctttgtcatcccatcatgagatttggaaacagcatggaaatggacgggatataagtaagcagcatcagaatcaccagcatggagatcaggaaggggacgatgccctgaatgacctggtccagctttgtttcaccaatgcggctggctacgaacaggttgatgccaaggggtggagttacaaatccaatggccagattgacaatcataacaataccgaaatggatgggatccacacccagacttgtaacaatgggcaggaagatgggcgccaggatcatgatggacggcgcggtatccataaagcagcccacgaacaaaagaacaatattgagcagcagcagtataatcagcttattgtcggtgagccgggtgatggcgccggcgatctgctggggaatttggccgatggtcagaattttggtgaaagcggcggcgcaccccagtaccaccagtactgtgccggtggtcagtccggcgctgcggatgacgccgaagatgtcgcgcagccgcagttccttgtaaatgaatacgccgacaatgaaactgtaaacgaccgatacggcagcggcttctgtgggtgtaaaaatgctcccataaataccgcccaggatgatgaccgggctgataagcgcccatttgccgtcccaaatggcggatagggtgcgtttgaagctgaaggggcgtccgtccccgctgtagccccgttttttactgataaaataggcgacagtcatcaatccgagtcccatcagaatgccgggcaaaaaaccggccataaacagctcggtgatggattgtcctgtcgaggtgcagaagatcaccatggggatgctgggcgggatgatgacgccgatacagccggctgcggcgatcaatccgagcacgaaccgcttgtcatagcccttttccagcatggtggggatcaccatgccgccgacggcggctacggtagcaggtccggagccggagatggcggcgaaaaacatacagactacaacggttaccagtgccaggccgccggtgattcggccaaaaatttcgttgaaaacattcagtaaccgtttggagatgcccccgccgcccatcagttcgccggccagcacgaaaaaggggatggccataatcgggaaggaatcggtggaggtcaccagattttgagcgatatagccgatgcttagacccagggaaggctccgctacaacagtgatcagcgaagcggcgccgatggcgatgccaacaggcacattgagtatgatcagcaggaaaaaagcgccgaacaggattaggctaatcatccaaagcacctccttgccgcaggcactttactctaagccagatggtttgtaaagtccggtaaaaggtgaggacgaatcccacaaagggcgccatatatacaaattgcattgggatgcccattgcggcggatttttgccccagcatggcgattttcataaacagctcataggaggttttgatgatgaaggcggaaaacaacagtacgacgatatcccccacaatgcaaatataaggacgaattcgttggggaaacagccacaaggcggcgtcgattttaatatgcttgcgctgcttggcggcatagccgatggccaggtagaccatccagataaacaaatagcgggccagttcctccgaccagctcagagaattgttgaagatatagcgcataatgacctggacgaagattaaaagactcatcacacacaaaaggacgaccatcaaaaggtcctccaaatggttgtcaatttttttcagcattgtttcaccccttgtcccttctgaatggacgggcagtttgcctgcccgccctgcgcaagtttattcctcctgcaatagctccagggtccggtcaaacagttcgggatgctccatttcattgcgcacaatgtcgttcacgctttggacggcctgctgaaactgcgctgtttcctctggtgtcagctctatgatctgggtggtcgcgtccttggcgatggcgtccaatgcctgctgttcatactgcggggcggtcgtccgctcgtattcggtcgcttccctggccgcgtcaaggacaatctgctgaaactcatcgggcaggctgttaaacttttcaaggttcatcgccaggaccagcggattatacatatgcttggtcataatgagatagctttgtacctcgtttagcttgttgtcgtaaatcagctccaccgggttttcctgtgcatcgatggtgccctgctgcaaggcggtgaacacctcgttgaaggccatcggcgtggggttggcgcccagggctttccaggtggccaattgaatgttgttttccatgacgcggattttcaggccgctcatgtccgcgggggtatgaatttcccggttggcggtcatgttgcgaaagccgttttccggataggacaggatcttaagatttttgctctccagtcccttggcgatctcttggccgatctctccatccagaatttcaaaggctttttcacgcgtttcgaacaggaaaggcgcgtcgaacaggtacaggtcgctgtaagtggctgctaagggggcgacgtttgacaaagtgatgtcgatatcgccgatctgagtggcctccagtacctcgcggtcggcgcccagagagttgtcggcgaacacattgacctggatctgaccgttggtgcgcgattcgaccacctctttgaacttggcgccgatatccttatgcgactgggggatccccacggccactttcagggtataagcggcctgttctccgccgtccgaagcggcggagccggccggcgccgcgctgtttgcggaaccggaagcgccggagcagccggccagaaggccgcttgtaaaaaccgttgctgcaagggccaaagcaatccgtttgccagttttcataatgaagtcctccgttcaatttagatgtgtgggggatggctatagctgttcagagaagccccaattcctttagccggatttttattttttctttttcctcctgcgtggccgggacaaagggccggcggggatagcattttacaatgccgcgcagctccagcatggcatagatggccagctgcgtcgagcgcgccagatacatgatatcgcgcatttcattgacttcaaactgcgttttgcggcaggcttttatatcaccggccatcccctctgaaaacatctttcggcagatttcggggaaggcgttgccgattccggggatgaacgccttgcagcccaggacacaagcgggcagccacattgcctccgtgccgagagccacgtcgaaggcgtcgctttttaaaaggcgcatatacttggccatggcctggatgtcaaaggtggcgtccttgactccgctgacgcccactttctctttcagcgtgcggatcagctccagttccataggatatccctggaattgagggttgttgtagacatagaccggaacgtggccctttgccgcgtccaccagcgtatgaaaatagtcgcagatgtcctcgctggaatgcttaaaatagtaaggtcccacggccgccaccgcggcggcgccgcattggacggcatgttccgtcaggcgtgcggcgctgagactgtcggctgtgcccacgtggacgatcaccgggatcttgccctgggcggccttgagcgtggcttctgccacccctttgcgctcctcctccgtcatcagcacgccgccgccgtaggagccgttgatgaacagcccgtccacctgtccggataaaaattggaccaatgcggccagcccttcataatccacctcgccgttttcacgaaaaggtgtgaccatgggcggcaccacgccatacatctgaaacatcttacatcatcctttccaatgatttgccgcgctgtatgcgttcgagggcgaccgctatggagccgtcgacggtcatccggtcaaggtcctccttgctgtgaacgcttttaatctcaagctgccggccaaactcctttttaagcatacatgtatacatcctgcaccggctctcatggccgtagagcaggtaaaagtcgctgtgatatccctgactgcgcatctcatgaaaggccttcaggtcatccgccgcgatggccgcgtccacaaaaatctgccgttcagagctgtttgttttcatcaacacctggagaaacctgggcatcagcatggttctgcccagtccggcatgacgcacgcagtccgccgcaatttcaatcaattcctcatacccgtagccgccggcttcctcgccttcaacgggcacgatgcttttgccgatgttggtggagctgaccatagcctcgtaaaactggccgctgatggtggtggcgcttgcttcgatctgacgcgcttcgttgatgtacatgatcttggtgtgtgaggacagcgcaaccagattgcacggatagggaaggctgtactggttcatgatcccgatacactgcacctcctcgccgcgcataaagtccacctgacgcagattctgcgcgcgtaccggttccggatagcggttgcgcacgccccggataaaatagaccggcctgcccagaggcagcacggactggtcggcaacctccaaaatcccgtcggaaagctcaggcagcccggccggcgcgacgagatgcgggatttcgatcaatcccacctccgaggtgatcatgccggaagcgatggcgaacgccacctgatccgcagggatctgatgttcccgcagaatctcaaaaaacaactccgtgacgccgtttcgcagtttgtcgcggctgccggtgatcgaggtgtcccgcacccccacctttttccggccggacgccacgatttctttttggtcattcaccagataaatgcgggtcatggtggtcccgcaatcgatgacggcaaacataacacaaaccctttctttctataatttggggtggtttaccggattttgcggcgtttcgccccttaaaacacgggcgacctcctccgcgaccttccgctgaaggctggcgacggcttcctcagaataccaggcggcgtgcggcgttacgaccgcattgtccagcttgagcaggggattgtcagccgcaaccggctcctgctcggtgacatcaagccccgccattgcgatttgcccgtccgatagcgcctggataagcgcctgctcgtcgacgacggcgccgcgggcggtgttcacaagcacggcggttggtttcatcagccggaacgcttcctgattgaagatatggcgggtgctttcattcagcgggcaatggattgatagataatcgctgtccataagaagctgttcaaagctcaccggcgtcacgccaagctcttgagctgcctgctggtcgagcatggggtcgtatgcgatcatctttaaaccgaacccggccatcttctgcgcgaccaggcgggggatacggccaaagcccatcagaccgagcgtgctgccctgcatccggtgcaggggcttcaccaccgtgtagctgctgcggccggccttcacctgacttgccaggaaggtcagttttttgacgcagtccatcagcagggcgatggcatggtttgacacctcgtcgatgctgtaatcgggcacgttgcagacataaacgccctgttcctccgctgctttcagatcgatgttgtcgacaccgatggcgtaccggacaatgaccttgcagcggggcattgcccggatgacccgcgcggtgatgggggcgaactgacagatcagggcgtcgcagtccgccgccgctgaaatgacctcgtcctcggtggcgcagtggtaatcaaacagctctccgcctgcctgccggatgatctcccgctcctgcgcgatgctctcatagtaatagtcggaaatgacaacctttggctttttcatttgacacctcgctttaaaagttttactatataaaacttggttttatatattgcttattttttaaaccttgcacccttgtgcaaggtttaaaacaaaccggcggctctactccacatagcccatttcctttgaaatctctgcggccgccgcccggatctcatgaagatactgctcggacttctttccaaagatcatatcctgcatcccgcacaggctgatccctgcgatcatttttcctgtttgcccatagataggggcgcacaggctgcaaacatacggttcattttctccgacattgccggagtatccgtcccgccgcgcctgccggatcagctccatcagggcgcttttgtccataaccgtgcggtcggtcaggcgtttgatttccacacggttcagataacgctccacctcctcgtcgctctcctgcgccagaaacagacggccgatgccggtggaatacagctcgcttctgccgccgctctgaaccgtcagctgtgtccagagcgggacgcttttgggaagcacctgctcaaccatggcgagcgcgtcgccttcgcggatgccgaggtagcagatcatgttgttgcggttgcagagcttctgaaggcgcttctttgcgattttgcggacatccagagaattgtatttcaactgccccagatgataaacttcgatcccaagactatactttttggtttcctcgtcaaaggagataaagctttcgttatttaacgtatacagcaggcgcagcatggaactttttccaataccggccagctcgctgagttcagagagcgacagctcctgatgctgctcgtcgaacagctttaaaatctccaacgccttctttacggagccaattgtataatcccgagttgtgttcatattgccttctcctcatttgaacaaacggcggcggaggccgcggccctaaaagagcacaacacccttgaacacgccggcctcgggacgcgtccaggcggcaagcgtctgccctgcgtcgtcaaaggctgcctgatgggtgataaattgcctggggatgaaagcgccgagccgccagaaattcatcacccgctcatagtcgggccttgtagagttgcgggtcacaaacagagaaggctcttttaaatggaaccgcagcccatccaattccaacgtgccgccgcagatgcccacaaagacaattttcccgccctggccgatccaacgccaggtctgctccatggaggctttcgcggcggtcgtatcaatcaccgcgtcaaaaagcgagtcctctgtgaattgtgctgtttgttctgtaaaatgttcatccaatgggtccagtgccaaaagccggaaccgttcggccgcgaaagcccgccggcccggatttgtgtccgacaggagcacgcgcgccccataggtctgagcgttcagagcgcagcttatcccgatcggtcccgcgccggttacaagcacgcggtcgccgggcgccagttccagcttggccgcggcgtgggcgccgatggtcagcggctccagcatggcgatctcctgcgcgggcgctggccggtctgttttcagccagttttgagccggtgcggcaaggtactcctgaagccctccgtcctgatggaccccgtacaggttgagccgcgcgcaggcgtttgtccggccgcgctggcatgctctgcatgtcccgcaggggatacagggcattaagcagacctggtcccccacggaaaaaccccggacgccttcaccaacctcagctacccgcccggcggcctcgtgcccgatgacgcgcggaaaggaaaacaaaggctgatcgccccggatggcatggagatcggagccgcagatacagaccgcttccatgcggaccaaaagctggcccggaaggcattgggggatggggcgttcctcatagcggaaggtattcgcccggtcgagtacaagtgctttcattctaccccctcccatcctattttgtcaaatatccgccgtccaccgggatggtggcgccgttgatatagctgccagcgtcgctggccagcagaacagcgattcccttgaacgaatcaggctccccccaatccccctgcggaatgcgggacaggatgtttgcgttgcgctgcgggtcgttgtacacggcggaggagaggtctgttttaatccatccgggagcaatggcgtttacattgatccccagactgccccattcgctggccatcaggcgggtcatccccattaccgcggacttgctggcggtgtaggcggctgtattgattccgcccagataggacatcatggaagcgagattgatgatttttccgccgccgccctgcctgacaaactgcctggcggccatttgggagagaaaaaatacggacttttgattgacctggatgatattatcccacatttcctcggtatattccagcgcagaggcccggggacagatccctgcgttgtttaccagaatatccagcctgccaaacgcattcaaggtctgttccataatggctttcaactgcggcatctggccaacatccgcctggattgggagaaacctgcgcccaagcccttccacgtaccgctgcatttcgaccggcggacgggttctgtacacacaggcgatggatgcgcccgcctccgccaatcctttggtgatgccgctgccgatgccgttgccgccgcctgtcaccagcgcagtcttgcccttgagtgaaaagtcgtcaaaaatcatggctacacctcctagttttattagataaaacttaattttataatataaaattttgtacgtttagggtatcacaaaaaagaggggtttgtaaaggggcaaaacgacacattttaaaaagcatttgttggcgaaatttactaaggggtgcgcttgaagattcggtaaatcagatttggatgcaggtttgactttatataaacagccggacgggcattgacccgtccggctgtaaaaagacgctattaatgcgctgctcccgctgcggtttacatatccgaaatgctgtcgaaacgcacgaagggcaggctttcttcaatcaggatgcggcactcggcggtaaagatgggttcgtccatagtccgctcccctgccagatattcgttcatcaggttgatcgcgttgtaccactgctgggcggggccttgccagatagtcgcaccgatgatcccctcgcgaatataggtgtacgtcatttccgtgcgctcataaccaaagacgagggtcgaaccgacgcggcgattatttttgacggccgccgccgcccactgtgtcaagccgttggtgacataaaaaacgttcatatcggcatgcgcctgcatctgctgttcagcaatttcatagatgctttggtaggcgatccgttccgactcgatcggaatatcgcagacctcaaggatttttgccgtggggtcgtgccgttttaaaaagtctgcaaatccggcgagccgtttctgcgtaccttcgaacaactgattggccgccagcacgacacagcggatgccggcgcccttatagagcagggccaagcgtcctgcaagcagtcccatcgcatagtcgtccgggccaacgtgaaacaggcggcgtgaattcggcacgtcctcgatcacggtcgcatacggaatttcgggtgggatcagctcatcgagctgggattcccggccctgcaccggcagcagcacaagcgcgtttacgccttgtgaaagcagacggagaagcgcctccttctggtcgcggaaggagtaggtggaaaccgtttcgaccgccagttcaacgccgaacggcaacagcttttcccgcgcgaaatggaccccgctcatcgcctccgcccagaattcgctctccacacgggagatacagaccccgattttgaagctgcttttacggttcaccagcgcgcgggcaatacggctcggccggtacccgagtgcttcgatcgcgctttgaaccgcctgcatattgcgcgcggaaaccttgccgcggttgtgcaccacccgatcgactgtgccgatcgacacgccggacagacgggcgacatctttgattgttggttgtgaggacataagccgacccctgatttcccctgaaaaggattttataatgcttattgcaaaatcttactcaatattatacatgcattccatccggttgtaaaggagcgggaagcgccgcgcggtgttcatccaggccgcaagccgccgtcttgaccagccagacgcttccctcgtccgggccgtcgcttccgatcgccgctgaggtgacgaggagggtgtccagcctgcttccgccaaaggcgacgctgctgacctgccgggcagggaagggcagttcttcaagaagacggccgccggaggtataccgccgcacgcagcccccgtcccaacaggcggtccagagcatcccctgcgcgtcaagcgtcatcccgtccgggaccgccgctccaggctcattcagcaaaacggcaatctgccggttggaaatcgcgccgtctgacacgttgtaagcatagcgatagatggcgcggtcgcctgaatctgtgtgatagaagcgttcgccgtcaagcgaaaaccccatgccgtttgaaattttcagcccctcgagcagccgtcttggcggctgtccgtattcaaaaagccaaagactgccatccctgttttcttcggtttttgttcccgcgagcacccggccggccgggtcgcagattgcgtcgttgaagcgttcgccgggcgccatcggcacctgccagagaagctgaaaatcgctttcatccccgccatatgggcagcggaataccccggactcggtcatcaggagcaggttgcctgcctggtcaaacagaaacgcgcccagctgatagcagcatttgagcaggcggcgcactgcgccgcctggagtgcaggcatagagcgttccattcaggatatctgtaaagacaaattcgcccgtttcacggtgccacagcggcccttcaccgagcgcgcagggcgcgagattgagccttaccattctgtgacgcagccgtcgtccagccggaaaacgggatttttccaggctaggtcaggctcctccatcgcgcgcaccttatcctcatcgacttcgagtccgagtcccggaccgcgcagcaggctgacaaagccgtcccggtactggaaaacggatttgtccctgaggtaatcgccgatctcctgccccttgttataggccataccgatgctctgctcctgaatgcaggcgttgacgcaggcgaaatcgacctgtaaacaggcggccagcgccacggggccgagcgggcagtgaggcgcgagcgccacatcatacgcctcggccatggcggcgatccggcgtacctcgctgatgccgcccgcgtgggagaggtccggctggatgatgtcgacgcagccgcgctccaacaggtccttgaagccccatcgcgtgtaattgcgttcaccggttgccagcgggatgctggtaaagcgatggaggcgttcgaacacatcgatgttttccacaagaaccggttcctcgacaaagagcggcttgagcggttccagctctttgagcagggtcttggcggttccctgatgggcgcggccgtgaaagtcgattgcgataccgaaatcagggccggccgcgtcccgcaccgcctgcaccttctccagcagcccggtgatggcgcggctgtcgttgatccagccgatacggccggtgccgagcatcttgatattgcgaaagccctgcgcttttttttcaagcgcggattttgcgcatatttccggggtgtccgaatcgatccaggaatagacctccatcttttcacggacgcgcccgccgagcagttcgtggaccggcacgccgagcgccttgcccttgatgtcccaaagcgcctgatcgattccggagagcgcgcttgtcagcaccggcccgccgcgataaaatccgccgcggtagattgtctgccagatgtcctcgacgttgcgtggatcggcgcccagcagatacggctccagttcgtggatacatgcctgtgtggtggcggcgcgtccctccacaactggctcgccccatccgatcagtccgtcgtccgtttccagccgcagcagcagccagcgaggccggatgcggaacgtttcaaccttagtcagcttcattcagagacccccgtttcatggattttgagcggcagcagcgcgccgccgttaaaggtgttttctggtacaaccggcagcagcgcgccgccgtcgacggtgatgcgcgtgccggtcatatagctgcacgcgtccgaggcgagaaaaacgaggatgtttgcgacctcctccggcgttgcaaaccgttggagcgggatgcgctcctttacctggttgatcggattgtcaggctcccagacattggtgtatccgggcgcgagcgccagcacgcggattttatgcggagccagttccatcgccgcattgcggcagaaggtatccacagcggctttgctcggcgcgtagatgtttgcctcgggaaagcatccgtccacatgattggaggcgatgttgataatgacgccggctgtaccctgttcgaccattctgcgggcggcaaactgcgtgccgaaataggcggccttccagtcggtgcgggtgatgcgctcccattgttcctcggtgacttcaagcagcgggtgaaactcgctcacgcccgcgttgttcaccatcaggtcgatcgagccgaatgcgtcgaaatacgcatcgaacaggccgcgcagcgcctggtaatcgcctacgtcggctcgaaaggcgagcgcctgcgcgcccgcttcgcgtgcgagccggcaggtgtcctccgcgcccgtccggttgttgcagtagttcacaccgacgtcgtagccgttttgcgccagtgcgatcgcgatcgcctttccgatgccgtggctcgcgccggtaatcagcgccttttttcttttcatactgattctctccttttttcaaaatccatgctttggcccgcggtacccccgaaggtgtgcggcgccacgcgctgtgggggtaagctcatgtcttaaaacctgttcaatatcttagggtgttccgaatgggcgggaattttttcgttcggcaatacaaaaaaatcgcagccaagccttggcggcttgcgagattttttaacacagaaggacggaaaaagacctgctcaggcggtgcgccaggaaatgctgaatgggttctgtggtcaaaacaaggagattttaatttgtgtgtacgttaactgaaattataacatgctttttacaacaagcaagtatttgctaaaaaattcacaaaataaacttataatttagtgataaagtgcaaattataatttggtttttgagacgtttttcacagaaagcaggagcaataaaagctgattttgttacgctaggagtttaaaaaagttataaaaagaaattgattggtataaataaacaaaaagtaataaaattttaatataaaacgatgaatatttctcaaaatattgacagggctatgcgcaaaagcctataataaagccgatgtgttaacgtaaacacaaatgcaaaaataccgtagaatgcgggaaggaggctgtaccaggatgggcaattctgtggaattcaggcatatcagcaagtttttcccaggtgtcaaggcgctggatgacatcaatttttgcgcggagagcgggcaggtctatgcgtttctcggagagaatggcgcgggcaaatccacgctgctgaaaattctaaacggcgattaccagccggactttggggaatatctgatcaacggacagccgatccatttctccactcccagggaagcgatcgcgcacggcgtgagcgtgatctatcaggagcgtcagattttgatggatatgacggtggcggagaacatctttctgggcgactggccgaaaaagaaaaacggcctggtcgatttcgctctgatgaaccggcgcaccgctgaaattgccaaacgcttcgggctgaatatcagcccggaaacaaaggtgggaagcctgagcatcgcccatcaacagatggtagagatcatgaaggccgtcagtcgcgattccaatatcatcgcgtttgacgagccgactgccagcctgagcgacaacgagatcgatatcctgttcgatatcatccgccaactgcgggcggaaggaaagatcattttctatgtctcccaccgcatgaatgaaatagcacaggttgcgcagaaggtcatcatttttaaggatggacgtcttgtcgagatcgtggatcaggcaactacccctgaggatcagatgatccgtctgatggtggggcggtcgctcggcgacatctacgacgccctgccgcgcagcgaacaccccggcgaggcgatcctcgaggtgaaggaactgtgcacgccgtatgtaagcgatatatcatttaccgcgcatcgtggcgaaatcctcggctttgccggattggtcggcgcgggccgcaccgaggtgatgcgcgcgctgttcgggcttgacccggtgtacagcggctcgatcgggctggaggggcgcgccatacagccgaaatcgcccgcacaggcgcttgcgctcggtttcgcgatggtgccggaggaccgcaagatgcagggcatcctgccaaacatctccgtgcgcggcaacataaccgtttcaatgcttaaaaagcttgtgagtccgatcggctttgtgatgaccgataaggaggagcaaatcgcccagcgggagatcgctgaactcaacatcaagactcccaattcggataagctgattgcgcagctttcgggcggcaaccagcagaaggtcatccttgcccgctggctggaaacgcacccaaaggtgctgattcttgatgagccgacaaagggcatcgatgtgggcgccaaggcggaattttacaggatcatcgccgcgtgtgcgcagcagggcatggccgtcatcgtcatctcctccgagctgcctgaggtcatcgggctttctgaccggatcattgtcatgcgagagggccggatcagcggagaggtcagccgcgctgacttcagtgaggagatcattttgaaatacgcgatggccagcgtcccgcaaaacgcggagcaataagcaggaggaacagcgagaatgaataacctgatatataaactgaaaaaaagcgactttgccgacaagatcacgctgattgtggcaatggtgcttctagtggttctgttcggcgcgctcaaccgcaactatgtcaccggcgcgaacatgatcaatatcctaatcgcctgttccctgaccgggtttgtggcgatcggtgaaacgaatctgattatcgccaaccaaaacgacctgtcggccggttcggtggccgcctgtgccggcgtgcttgccgcgatcctcgcgcgcgagggcgttccggcgattctggcgctggcgatcgcggtctgcgccggctttctggtcggagcggtcaacgcggggcttgtcaccttcctcaaattacagccctttatcgcgacgctggccaccatgtcggtggtgcgcggcatcgcttatatcctctgcaacggcaaggcggtagccatcagcgacaagacgtttattaaattcggcaattaccgcatcttcggcattctgccggtgccggtcctgcttctcctgattgccttcatcgtattcggcatcatattgagcaagacgtatttcggacgcagcatctacgtgctcggaggcaacacctacgctgcgcgcctggccggactcaacccgacacgcatcatcttcaagctgcacatcatcgaatcggggcttgccgctttcgccggcgtgctgctggccgcgcgcatgaattccgggcagccgtcggcctgcaacgggcttgagtttgacgccatcacggccgccgttctgggcggcacggccttcaccggcggcgtcggcacgatcttcggcacctttttggggatgcttgtgctccagggcttcaaaaccgggctgaacatggttggcgtgcagaccttctggcagcaggtcgcgcagggcgggttgttggtcgtggcgctggcgttcgacttttaccgcaagcatacacgtgacaagcgcgcgcttgaggaaagcatggccgcgcgcggcgcgcagctgccgaacaagaaggcgcgcgcctgatgcaaaaggatccccgcgggcggcggacgcccgcttttagctcctgtattcacagcctgtggatgcttgacaagcgaggaatttttccagccggtcaaggcgcatttttgcaggcgggctgtcgcccggcaaaaaaatttaacgccaagcggggaaaaaagcccgcatggacagtgcctaacggcttcgaatacaggttcttacacagaaactgatcagcaaaggagaagaatcatgaaaaaatcatttctgaaaacgcttgcgacagggctttccgtagcgatgctggcggcgatgaccgcctgcggcggctccacgacggcctcgtcctccgcggaatcgcaggccgcgccggcagacggcgcttccgcaccggcgcagagcgcgcccgccgattccgtgtccacaggcgacaaaacgattgtcggcatctacaagatgggtacggcgacctggtttatccaggagggagcggcctcccaaaaggtggttgaggacgccggctacacctggaagtttatggactgcaaccagaatgccgcgacgtatatggacctgctcaacacggtgatcgcggataaggtcgacggcgtgctcgtctgcctgccggaccagaacctgagccagacgaccgttgacatgctcaccgaggcggggattcccgtgatcgcggtggatgacgcgcttgaaactgaagacggcaccaagctggccccgtgggtcggtatcgacggcttcagcatcggcaaggccgccggcgagtggggcgtcaactatatcaaggagaacaacctcgccgatgacgagagcttcggcatcctgctgatgacggccgacaccgtttcctcctgcgtgccgcgcaccgagggcgagctggcggcgctctccgaaggcctgcctgatttccctgaatcccgtatcttccgcgccgactgcgacacctccgccgaggacggcaaccaggccgccaacgcggtgatcaccggtcatcctgagatcaaaaaatggctggtgctcggcgtttccgacgagagcagccagggcgccgcgcgcgccatcgaatcagccggactcggcgctgattcgatggtcatgggcttgggcgcgtacctgtgcccggacgaatttgaaaaccccgactcgtgtttccgtgccgcggcttacttctcggcgcgcgacattggcggcaccgccgcgcaggaaatgatcgactatcttgagaacgggacagaaattcccgagacatacgctgtcggcgcgaccatcgttgaatacggcgacgatctggcaagcatcatgccggaatatgtaaacggataatcccgcccggccggcgatagaggttccaaagcctgttcaggtgttcgccttcctgaatgaaacctgttggcagggggattttgaataggctttcataaggccgcggagcataaaaccctgctgcgcggccctctttttggatgaaattgccctgccggataaaaaagagagtgataacatgcgaaaaattcgatttgaaaccatggtcccggcagaactgctcgaggcggtaaacggccggagcctggtctatcagccggtcggcagcatggagtggcacgggccgcacatgggcatggggatggacacaataaatgcccatgcggtcgcgctggaggcggcccgccgtaccggcggcgtcgtgatgccgccattgtatatcggcaccgaaacgccgcgcagccccgaaacgctcagaaagctcggcttttcgggcgatgaacgggtcgttgggatggattttccccaaaacagcgtagcaagcttttattggccgcccgatttattcgaggcgatcatccgccggcagacgcagatgctgcttgagatgggattttcccaggtagtgctgctcaacggccacggggcggatgcgcaggttgagattctggaacgcgtcagcagggagctgtcggtgcagagcgggcgatgcgtgatgaccataatggccctgttcgacggctgcggcgctgggttgggacacgcggggctggcggagacggcgatcttcgcccacctctgcccggaagctgtcgaattggaccgcctgccgccaaagccgcagaagctttacaatacacggtgggggattgcggacagcgagacgttccaaaaaggcccgaacgaggatttcagcgtgcggtacgatccgcgagacgccacccccgatttgggcgcgcagattgtggaatatacggtgaatcagtgtgtgcgtctggtcgagcaggcgcacgatgggaaagtacccgcgggaaactgaaggggaggtcccggacgcggcgcggccgcggaaaattttccaggaggatatggatgcgatgatgagacagattaccgaaggcgtagccgtctggcgggaaaatgtagtgattccgacctatccggtcggcaagcccgataaaaacccgatgtttctggaaaagcgggtgtatcagggcagcagcggccgggtgtacccgcacagtgtcattgataaaatttatgatgaaaaggtggatcgcacctaccaggcgctctgcctggaaaataaatatctgtttgtgatggtcctgcccgaattgggcggcaggatccagcgcgcgtatgacaaaacaaacggctacgattttgtttattataaccatgtgatcaagcccgcgctcgtcgggctgaccgggccgtggatcagcggcggcatcgaattcaactggccgcagcaccaccgcccgagcacctttgacccggtcgactgcacaatccgcgagaacccggacggaagctgcaccgtcgtggtcggagaaacggaaaatatgttccgcacgcgcggcacggcgtccttcaccattttccccgacaaagcgtacatcaaaatcgacgcgcagatctacaacagcaccagtctgccgcaaacatttctctggtgggcaaacccggccgtgccggtcaacgacgacacgcagtcggtctttccgccagacgtacatgcggtgatggaccatggcaagcgcgatgtctcacgcttcccgattgcgacgggcgtttattacaagcaggattactccgcgggcgtcgatatctcccgctataaaaatatcccggtgccgacctcctatatggcgtatcattcggattacgactttgtgggcggctacgaccacggacggcgcgccggcatcctgcatgtggcggatcaccatgttgcgcccggcaagaaacagtggacctggggctgcggcgactttgggcaggcatgggatcgcaacctgacggatgaggacggcccgtatgtcgaattgatgacagggtgctttaccgataaccagccggatttcacgtggcttgcgccgtatgaggaaaagaccttcacccagtatttcatgccctacaaggaagtgggaatgatcaaatgcgcgtcggtcgacgtggctgtgcgtctcgagctggacgggcagacggctgatctggccgtatacgcaagcggcgagtttgccggcgcgcgggtcgcgcttgaaaaggacggccaaacgctctgggagcggacgctcgacctctccccggtcagtatgctgacggagcttgtcccggacgcgggcggcgatccgaccgctttgacgctgcgggtgtccgacgcgcaggggcgcctgctggtgagctatacgcccgagccggaacgcatcgaaaagacgcccgagccggccaaggcggctcccgacccggcggacgcgcgcaccaatgaggatctgttcctttacgggcagcatatcgagcagtaccgccacgcgacctatctgccggaggattattatctcgaagggctgcggcgcgacccgaccgacgcgcgcatcaacaacgcctatggcctgctgatgatgcggcgcggccgctttgagcaggcgcagcgccattttcgcgccgccatcgccaagtatacccgctccaacccaaatccctacgacagcgagccgtattataacctcggcgtctgcctgaaattgacagggcgccttgacgaggcgtatgatgcgttctacaaagcgacctggagcggcgcgtggcaggcccctgcgttttacgccatggcctgcgtcaaagcggcgcagggggattttgatctggcgctttcccatgtggagcgcagcctggtgcagggcgcgcacaacctaaaggcgcgcgcgctcaaggcggcgctgctgcgccgcctcgggcaggaacaggccgcgctggccctggcgcgggagagtctggcgatcgacccgatcgactgcgcggcgcgctacgaattgggcggcgaaacacgcgaacggctgtttgcgtcgatctgtgaaaatcccaactggtgcgtcgagctggcgctcacctacgccgacgcggggctttatgccgaggcggaggaggttttgacggcggcgtccgacgccggccagcattatccgctggtgcattattatttggccgatttctgcgagcggcagggaaaacaggacgcggccgcgcgccagcgcacggccgcctcgtctgcgccgtccgattactgcttcccgcaccgcctggaggatctgcttgtgctcaaccgggcacttgagaaaaatccggacgacgccaagggttggtattacctcggaaatctttggtacgacaagcggcaatatgcgcaggcaattgagtgttgggaacattcccgcgcgctggatggccgtttcccgaccgtgcaccgcaacctcgcgcttgcgtactttaataaatgcggccgcccggatgacgcgcttgacgagatggaacaggcattcgccctcgacaggacggacgcgcgcgtgctgatggaattggatcaactgcgcaaaaaacgcgggatgagtgctcccgagcgcctcaaggcgctggaggaaaaccgggaatgcgttttacagcgggatgacctgtatttggaatacatcaccctgtataatgcgcttgggcggcatgaacaggcgctcgaaatgctcctgggccgacagttccatccgtgggagggcggcgaaggcaaggtacccgcccagtacaggctggcgctgacggagcttgcaaagcgggcgctggcggccggcgacgcccaaaaggcggctggactgctgcgccgggcgacggtttatccgcacagcctgggcgaggggaaacttgccggcgcgcaggaaaacgacatctactattatctggggctggccgaacgcaggctcggcaacgcgcaggaatctgaacgctgcctgaaaaaagcgtgcgttggacttggcgaaccggccgggatgatgtactataacgatcagccgccggagatgattttctatcaaggcctggcgcatcgggcgcttggcgacgagcatggggcgcttggacgcttcaacaagctggtcgactatgcggaacagcatttgcaggaccatgtcaagatcgattatttcgcggtgtcgctgcccgacctgcaaattttcgaggaggacctcgatgtgcgcaaccgcgtgcactgcctgttcatgcgcggcctggggctgcttggcaaaggggatgcggcgcgcgccgacgcctgcttcgccgaagcggagcggctggatgcaaaccatatgggcgtgcggatccaccgcggcatgaagccggatttttaatcagggaggaggcgccggatgcggcggatcaattttatgggcgccgacggatgggcgcttgagaacgaggcgctttcagccgttgttctgccggcgcatggcggcaaggtcgcctcgataatttacaggccgcgggggtttgagctgctttttcaaaacccaaagggcgttttccgccgtgccgggcgcggagacgatttctccatgttcgaggcgtgcggatttgacgaggcgtttccgaccgtggacgcctgcgtgttcgagacggccggcgaaacgctttcctatcctgatcatggggagctgtggtcggcggcgttcgaaccgaagatggacggcggcggcatcctactttcctatcacagcccggtcttgggctaccgctatgagaagcgtttttccctggaggatgagcggctggtctgccgctaccggattgaaaacccaacgggccgcgacctgcctgcgctgtgggtctgccatctgctggtgcggtgcgagccggatatgcgcctgctgctgccgcccggtgtgatgcaggtacagaatgtcttttccagcgactggctggggcagcggcgcgcgctgctgtcttggccgctggccgagggaccgcgcggccaggtcgacctgtcgcggatgccgccggatggacagctcaagtattatgtccgcggccgtgtgcgcgcgggccaatgcggctatgaatatccccggtcgggggtgcgcgcgctgctttgctacgatccggataagctgccatatctcggcttttgggccacggccggcgggtaccgcggggatgtcaactgcgcgcttgaaccggccaacggttattttgacaacatcccgaccgcgcaatcgtttggcgcctgcccggtcctgcgggcgggagaaacgtgggatttttccctcgcggtcgccgtctctgagatcatgcgcgaataaaggccgcgtccggcattcacaattcacgaaaagcgccgtcatgcggatttgccgcatgacggcgctttacatgccgtctgtagaaatattcggtttacccctgcaaaggcgcttcgccgggcatgccgcccgccatccggccgccgtcccggtccggaccgcgttctccggacatgccggttacctccgacccgtcgctggaaatgcgggtgagctgttcggaaagcgtgacgcttgtaagcgtttcgccgtcaacgcagagggtatacgtttcgccctgcgtaagcgccggcgcggaaagcacgagcgtctggaagggctgcgccggcacggcggacaggatggtttccccggcgctgtcgagcagggtgatttcggcacccggcggctgtgatccggtgaagtacaccataagaacagcttgcgtaccgtcctgcggcgcctgcgccatgcctgcggagccggaagcgatgagcgtgccgccgttcatttctgcgcttccatcgaaatcaagcgcactgtccgcgccggaggtcgggccgtttataacggttgtcccgccatccaggtagagattgccgttggaatcaagcccgtcgccgtaggattgaactgtaagcgtaccgccggtgatgcggatatagtaggcgtcgcgtgcggcgaagcggtcctgcccgaagccggcgccaatgccgccatcgctgccgccggctgcattgacgccgtcatcgcttgcagtcaggtcgatttctccgccattgatgtcaaccgtggcgctctcaagcccctcatagcaggtatcgatttggataacgccgtcgtcaataacgagagcgccatccgcatggaaagcgtcgtcgccggtcgagatcgcaaaggttccgcccgagacggtcaggctcccgttggaatggaccgcatcgtccgcgctgtcaatggtaaatgtaccgccgctgaccgtcagggaggtcaccgccttcaagcccttcatactgttgctggtatccgattcggcagcggctgtcgaatcgagtatggccgcctgattggaaggagccgtttcgctgtcagcaggcggcatgctatcagacggcgccggatcggcagaggctatcgagccgtcggaggaggccgcgccgctctggacagtcggcgcgctgccaggggatatcgtttcgctgtttgggggtgcctgcatgccttccggcggcgtcataccgccagcgtagaatccacccgccatacctgcgccggggcggccgccgccgaagtcctgcgttttccgtgccggcgcgttggcgctgccgccgcccgttacgatcgtataagtcccgccggtgatggtcatgtcggtttccgcctggatgccgtcattgcccgcagtgatctggtagactccgccggacagggtgatccagcctttttcagcgtcctcgtcgttgttcgatttgatgccgtcgccttgggcgtcgattgtgaaattaccatcggtgatggtgacggaatcacgtccgcgcaggccgtcgtttgccgctgtgacaatgagcgtaccgctttcgatcagcaggttgtccttgctgccgatcgcgttgttgaagctgccggttacggtcagcgtgccgctgccggcaattgtcaggtcatccttagcgaagatggccgcgtccggttcgtcgccgccgtccggataggcgtactgcgctgcgtcggatacgctgttttgtgtgccgtcctgaagcaggagcgttgttgtcccggcctgcttggcatagatgcccgcgctgttggagcaggagatattcgcgttatcaagcaccagtgtgaccgcgtcgtccttaccggcgtcgatcacgatctgcccgtcgtcaagcgtgcctgtaatacggtaggttcctgcatccgaaattgtgatgacggtgccttgcacagcggctccttttccctgaacagaggcgctgccgccgttcagggtgatggtggctgccgcggcggccgtctgctccgcattgacatcgggagcggccgaagcgcagccagtcagggcggtacacacagcaatcgatccggccaacgctgcaaatatatggttgtgtttcataaatgcctccttacaattcgtcacgggcggaggaaatccgcccgcaggtgatgtttaaatttccattgcggcagcgcagttcatcgatcaatgctttgctgatgccgtcgcctttcagttcaacgagatagcacagctcgtacaggcttcccatattggtggtgcgcacgcgctccagctcggcgcgtgtggtatattttaggagcaagtcgtcaaaaatcccctcataatccaacccttcgggtatggtgattttcagctcccgctgcgtacgcggcgcgctgccgaagtccgctgcattcaaaaggagcatcacggcgccgaccatcacaagaaacaacgccgcatagccgagatagcccataccgcaggcaaggccggccgccatcgcgaagaaaatgctcccgatttcccgcgcgctgcccggcaccgaacggaaccggacaaggctgaacgaccctgccacagccacgcccgcgccgatgttgccgttgacgagcatgatgacgatctgcaccatggccggcagcagagcgagcgtcaccgcgaagcttttggtacagccgccgccctggcgcagatgcagcagggcgatgcacacgcccatgacaagcgccgcggcggtgcaaagcatgacgccgggaacggtcacgccgttttgcaggacgctttgaaagagaagatcaggcacagccaagccctcccttccatacagcttcacgcgacagataccgccgataacagaagccgtattttgaaaaggagactggatagacggccaggctgtccagcaggcgcgccagccagagcggcatgacgcctggaagcttcagctccatcagcacgtacccatcgccgcacagcggcgcgccccaatcgcctttttccagttcaagcgcccggccgcgccaacgcaggtccgtgtcaaacgtggcccgcagccccggctcgccgggggcataaagcgcgatgcggtcataagccagataaacctttggctcgggctggtaaaattgcagcgcccaagcgatttccctgagaatctgcgttccgtccgcacgcttcgcgccggacaggatggcttgcgcctcgtccggtgcgagcgcggcgcggcgcttatagacgacgccccggtatttctttttcaattccaaaaacacctggctttgcgcgttgggaacgccatagctgcgcaggcgcagcttttccttataaataggcttttcgagcgatgtgcggatcaaatgataatcgggcgtatcgtaatatatattacagatcgtataccgcccataatcatcttcgcgcatcctgtcaagaagcagcccgcgcagcacatggtactgatcgggactgagccaatattttttctcatagcgtgcaaaaacttcctgtgccatgagcgcacctccattttgttgataagggcatcatactgcggtttgctgaaaatagtctgaaaaaagcttttcagactattttcagctttgccatttatgatgaatgcgtgaagggacgctttgtggtacaatattcgcaagatgattatcataccatacgacgcccgacggctcgccgcatacgcggcaatcgcgcacagcttatatcttcatttgacgcagcttgcagtgcgtcactgcgttttggagcgcgcatcataaaagcagacggatggaaaggatggcaaaagatgcgggtattgattgtggaggatgaacgaaggctggcagacgcgctctgccagatcatgcgtgaacaaaaatacggtgtcgacgctgtttacgacggtcgtgacgggcttgactacgcgatgagcggacagtacgacgtggtggtgctcgatgtgatgctgccggaacgctccggctttgaggtggtccgggcgctgcgtgcgcaaaacaacgctgtgccggtgctgctgctgacggcacgcgacgaaatatcggacaaggtgacggggcttgactgcggcgcggacgattatatgaccaagccgttttccccggaggagctgctcgcgcgggtgcgggcgctgtcacgccggcagggggaggtgcagcatgaggagcttcggtatgcggatctgtgcctgaatctttccacgcgcactctttcgcgcggtgaaaagtcggtttccctcggctataaggagtttgaggttttgcacattttgctctccaatccgcgtgcgatcaccccgaaggaggagctgataacccgcgtatggggcgccgactccgacgcggaggacaacaacgtggaagcgtatatctcatttttgcgcaagaaattcttttatcttggctcgcagacggcgattagcgcagtgcgcaaggtaggctaccggctggaggcgggcgtatgatccaaaagctgcgtaaaaaatttgtgctggtcaatatgctgcttgtcagcgttgtattgctggtggtgtttggcgcggtctgtttttccagttatcaccgcctgcggcgcggctgtctcgatgcactgcaccaggcaatcagccggccgatggacgataaaccgccgcgtcttgagcttggggaggttaagcgcccgccgcagtggcaggccgaaatggcgccggtatttgtggtggagctgtccggcgacggttcggttgcgtctgtcaggggacagaatatcgcagtcgataccgacggcatggagacgctggtaaatacggcgctggcgcaggggcagaattttgggctgctgcacggctatgggctgcgttacctggtgtcggacggccgggacgggccgggcacgcggatcgccttcgcggatatcagcggccagcgcgctgcaatggtaagcctggcggcgacgtcgctggtggtggggctttgcgcgctcgcggcattttttgtaatcagcttgtacctggctaaatgggcgctgcgtccggtggaacgcgcctggcgtcagcagcagcagttcgtcgcggacgcgtcccacgaactgaaaacgccgctgacggtgattttagctaatacggaaattttgctctcccaatccgcgggtatgttgccggagcagagaaaatgggccgagagcagccgcgaggaggcgcgccgtatgaagggattgatcgacgacctgttgtttcttgcgcggtctgacgcatcaaaggcagctccggttttttccgtgtttgatctgagcgacgcggtgtggagcgcggcgctgccgtttgaggcggtcgcgttcgaacagggtgtgcaactttgcacacagatcgacccggggctgcaatatttagggcatgaggggcagatcagacagcttgcagcaattctgatcgacaatgcatgtaagtacgccggaaggggcggtacggtgcttgtccgtttgtaccgagagggggagacggcaacgctcatggtgcagaattccggcgctccgatccccaagcaggcgctgccgcgcctgtttgaacgattttaccgcgcggattcctcacgggcgcgcgcatccggcggatatgggctggggcttgcgatcgcgcaggcgattgcgcaggcgcataaagggaagatatctgtggaaagcggcgagccgtatgggacgcgcttcaccgtgaggctctataaggcgcagcagaacacataagaacgaaaaaagccgccgcctgctatagcgggcggcggcttttatgcccccttgtttattgcgcgatccagtgcggcgcggacgaaggcgcggaaaagcgggtgcgcgcggttggggcggcttttgaattcaggatggtactgcacgcccagatagaacggatggccgggaagctcgactgcttcaacaagacgtttgtccggcgatgtgccgcagatacaaagccccccgctttccaactgtggacggaatgtattgttgaattcatagcgatgccggtggcgttcgcgcacttcggcgcagccatagcagcggtcgagcagggtgccgggcaggacggcgcagggatatgcgcccagacgcatcgtcgcgcccttggagcgcacatccttttgatcgggcatcaggtcgatcaccggatgtccagatgtgctgcgaaactcaccggagtcggcgtctgcccagcctataacgccgcgtgcaaattcgatcacggcgacctgcatgcccaggcagatgccgaaatacggcatgccgctttcacgggaaaagtgggcggcggcgatcattccctcgatgccgcggccgccaaagcctcccggcatgatgacgccgtcggcctcggctagacgcgccgccgtgtttgatgcggccagctcctcggaatcgacccagtcgatttcaatcctggcgccgttttcccagccggcgtggcgcagcgcctctgcaacagaaagataggcgtcgtgcagcttgacgtatttgcccacgagcgcgatgcgcaccgtttcactgcatttggcctggcggtcgagcattgcgctccattcgcgcagatcgggcgcggggcagtcgagcgccagctcgcggcagacaaccctggcaaggccgttctgctccagcatcaggggcgcctggtagagcacaggcagcgtgcgattttcgatcacgcagtcctccttgacattacaaaacagtgcgatttttttgaggacctccggatcgatcggcctgtcgcagcgtggtacgatgatatccggcatgatgccgagcgattgcagctcgcgcacggagtgctgcgttggctttgatttctgctcgcccgaggattggatatacgggacgagcgtaacatgcaaaaacaggcggttgcccgcgccggcctcgtggcctatctggcggatcgcctccaaaaaaggctgcgattcaatgtcgccggtggtgccgccaatctcggtgatcacaatatccgcgccgctgtgctcgcctgccgcgtagataaacgatttgatttctccagtgatgtgtgggatcacctgcactgtctggcccagatattcgccgcggcgttccttttgcagcacattccagtagaccttgccggtcgtaaggttcgaaaagcggttgaggtcctcgtcgatgaatcgttcatagtgcccgaggtcaagatcggtttcaacgccgtcctcggtgacatacacctcaccgtgctggtagggactcatcgtgccggggtcgacgttgatatacggatcaagcttctgcgcgacaacccggtatccgcgcgctttgagcagacgtccgagcgaagcggctgtaatgcccttgccaagtcccgatacgacgccgcctgttacgaagatatactttgtctgtttcaattgaatcgctccccagaacagacgcgtggcatcgccgcgcgtcctcctttttatcagatatcagttttcgtaggtgcggatgatttccccggcaatttcacgctttgtcatacgcagatccatcgcttgctgttcaatgtagcggtgcgcctgcggctcggtcatgccgagcgtctcgatcaacaggcatttagcccggtcgatcagccgcaaatcctgcaactggcggtgcaggcgggcattttcttccagcagggaagccagccggttctgtgccgccgcgataaaacgcagtgcctggtcgaacagacggcggtcgatcggtttttcgattacgaaaacacccgcatcgcaaaccttctgcgctgcttcggcggccatgtcggcgcgtgcgacaagcaatatccccgcgccagtcgactggctgacgcgccgcgcaagctcgcaaccgaattcatcgggaagcggcgcgttgataacgaccagatcgtatgcgccgtcgagcgtcaggcggcgtgcttcgccgccgttttttgccagcgccggggcggcgggaaagtagcccttcagcagcgcacagagatatgctgtccccttttcggtgctcgatacaagcaggacacgctccatcagctcaccccttttcgttttcaaagcggacgcgggatcagacgcggtcaaaataaagcttcagctctgtctggtggcggttttcggtgcgttccattcgttcagcttcacgccgcttctgttcgcagtagcggcgcagaagcgccgctggaagatgccgccggttaaagtccgaggcggcggcacattccgcagcttctcccaggccgcgcggcagaagcgggtaagcatttgatggctcggcatcgtacaggttgatgtccacaggcggcgtcagcggcagcgcatcggcgattccatccagcccggcatgaatgatcagtgccagggccagatatggattgcaggcagggtcgggcgaacgcagctcgatacggctgtattcgccgcgcgccgccggtatgcgaataagctgcgaacggttgccgcgcgaccaggtagcatatttgggcgcttcgaatgcgccgaagcgtgcgtaggaattggtcagcgggtttaaaaaggcggtgatatcgcacgcatgggcaagcaggccggccatgaaatgatccatttcaggcgcgccgtgagcaaataggttctttccgtcttgaaagagagacagattgatatgcaggccgctgccgctgtactcgagaaatggctttggaagaaatgacgcatataagccgctttgggccgcgatcgatttgacagccgccttgaagccgaggagatggtcagcggctgtgagcgcacccgtatagcggaaatcaacttcgttctggccggggccctgctcatgatgggagctttccgggcgcataccgagcgattcgagtgtcaggcagatttcgcgccggatgttttcgccgcggtcgagcggtgcgatgtcgcagtagccgccgcggtcgtgcgggatcatggtaggacggtcgtattcgtccgtttcgaacaggtaaaattcacattccgcacccacctggacactgtagcccatttcggcggcacggcgcgccgcctgcttgagcagggcgcgcgcgtctgcgtcatacggcgcgccgtccgggcggacaataccgcagaacatgcgcgccacgcgtccctgtgccggacgccagggcaggacggacagcgtggctggatcggggaccaaaaacaggtcggaatcctcgacgcccgcgaagccgccggccgccgacgcgtcgaaggagatgccctcctcaaatgcgcgctgcagctcgctggactggatggcgatgtttttttggaaaccggacagatcacagaaggccagacggataaatttgacatcgttttccgcgacaaactgcaaaacgtcctgactggtctggttcatatgcatgaccacgcgcccgccgcgggcgcttcctttctgttgtggtttggggtgctgcttacaggactgtgtaaagctggcggtatggattttttgtatcgggggtgagcagtgtaaagggctggccgagcagcgcgtccacgctgccgccaaaggctgtgcagaaggcttcgagcgccggacggatggcttcaagcgcctggggcgcggctatttgtgcgagcacctgctttggcaggtcgagaccggtgtgcaccccgcgcagatagatccgtccgccgtgcatacccgtgccgcagaagtagcctacggggctttttcgttcttcgaggtttaaaacgatgatttcgccgccggcctggtattcgccgagaaagctgcccgccgcgccgccgatgacaagctgcgggatcttatcgcggtaggccttcatatggatgccggcgcggtagccggcgtcgccctgaatcagaatccgtccgccgcgcatcgcatagcccgcggcgtcgccgcaggagccgtgcacgatgatgctgccggcgttcattgtatcgcccacggcgtcctgggcgttgccgaacacctcgatctcgctgccgtcgagatatgcgccgagcgcgttgcccggcgtgccgtgtatcacaatacgccggccgcttgatgcgtccccgagataccgctggccgagcacatgcgtgaggatgatttccggcgcctgcgcggcggcgagcgcgtcgttgagcgccctgaagtcaagtccgcgcgcgtcgatagacgctgcgcataaagtttgaacggtcatcttgtcaacccctttattcgccggcgtgcctgacgccgaggatggaaagttctttttcgttcagtccgacgccgcgcagcatcaaacggttgccgcgcagcgcctcgatcgagttgatgcccatgccgcccatcatctccttgatttcatgtttccatgcggtgacaaggttgaccagacggcgcacgccgtcctccgggtcgagccgggcggtcagttcgggacgctgggtcgcgatgccccaattgcacaggcccttctggcaggagcggcacagatggcagccaagcgccatcagcgcggccgtgccgatatagactgcgtccgcgccaagcgcgaccgctttgacgacatcggcgctcgaacggatactgccgcccgctatgatagacacctcgtcgcggatacattcatcgcgcaggcgctggtcgacagcggcgagcgccagctcgatggggatccccacattgtcacggatgcgcgcgggcgcggcgccggtgccgcctgaaaaaccgtcgatcgcgatgatatccgcgccgctgcgcgcaatgcccgaggcgatcgccgcaacgttgtggaccgccgcgattttaacgatcaccggctttttgcgcccggtcgcctccttgagcgaatcaacaagctgacgcaggtcctcaatggaataaatatcgtggtgcggcgcgggggaaatggcgtcggagccttcggggatcatgcgtgtgcgcgaaatatcaccgatgatcttcgcgcctggaagatgcccgccgatgccgggctttgcgccctgtcccattttgatctcaacggccgcgccggcgtttaaatagtcgacatggacgccgaaccgccccgaagccacctggacgatcgtattttctccatacgcataaaaatcctcgtgcaggccgccctcgcctgtattgtacagtatacccaattgccgcgccgcacgggccaggcattcgtgcgcgttgtagctgatggagccgtaggacatggcggagaacagaaccggcacgtcgagcgtcaattgcggcggaaggttgtcgaccaacaggccgtttccatcgcgctcaatacggcccggctttttgccgaggaacacgcgtgtttccataggctcgcgcagcgggtcgatggagggattcgtcacctgtgaggcattgatgagaagccggtcccagtatacgggcaggggctttgggctgcccatcgaagaaagcagcacgccgcccgtctcggcctggcggtagatttcgttgatcgcatcgtttgaccagttcgtattctcgcggtaggtgtggctgcttttcacaatgcgaagcgcgtgcgtcgggcagatggccacgcaccgctggcagttgacgcatttggcgttgtcggccgtcatgcgcttttgccggtcattgaagccgtgcgcgccattggcgcattcgcgttcgcacaggcggcagcgcgtgcaggccgcgtcgtcgcggacaagctcgaattcaggagcgatatatcccggaatcatgttgcgtccactccttccataagcctgacaatgaccggttcgccgccgcgcggcgcccagatgcgctcggggttcggttcgacggcgcggatggcgctttcctcgctggcgacataaaaacatccgcccttttccgccgcgaccatcgaacgcagcttgagccggtcgttgagcgccatcatgccgccggtgaagccgagcaggattgaaaacggaccggtgacaagcaggctggagaatgcgctgcgcagataggtgagctgctcgcgctgcggcgacggcttttttgcgatagtcgaccagaacggcgcggcgatgacgctggccgtctcctccagtgtcaggccgcggcggcggttgagaaagtctataatataagtgatgacctcggtgtcggtcagcagcgtgcagtggtagccgtgcatctcgatcgcgcggcggttggcgtcgtaggaggaaatctccccgttgtggacgatggaataatcgccgagcgcaaacggatgcgcgccgccccaccagccgggggtattcgtcgggtaacggccgtgggctgtccaggagtagccggcatagtcctccaggcggtagaaacggccgacgtcctcgggataaccgacagccttgaaaacgcccatgttcttgccgctggagaatatgtaggcgcccttaagccgcgcgttgatgcggatgacgcagcgcatggtaaattcgtgctcgtcaagctggctggccgcgagcctggtaggcagcggcgtgacaaaataacgccagatcagcggctcgtcggtgatggagggaagcttgcgcgtggggatacgcgagagattgatgatatcgaagtgacgttccagaaacttttcgcagtccgccttgacatcgctgttgtcataaaagacatgcagcgcgtaataatcacggtactcgggatagatgccgtaggcggcaaagccgccgcccaggccgttggagcggtcgtgcatcagcgcgatggaacggatgatggcttcaccgctcatacggcggccgtcccgcgcgaagatgccggagatcgcgcagcccgaaggaatgcgcatctggccttctttaagcatgtcggaacctccagggggccgtagacggcccattttttcccgcggcgcctaagcgccgcaaaaaggcgctcataaaggggaaaagtcctctttgcccatcccctttatgaacgcctttgttcaatggaattattataaaaaaatgcaggaaggttgtcaattaactttcaaaatttctctgttttacaacctgaaaagcggttgatacggctttatttcgtgcgtatttcataaaatttgaaacattttctttttttcctgcaaaaaagaggttgacagatcacctgatcggcactataatgcagccatagcagcaaaggcgctgcgggacagtggttcccgcggcgcttttttctttaaattgccgaaaggacttgattgttatgagcagaaccgttattcccgccggctatcgtcccgccgagggtctgggactatacgacacgcaggcggccatcaacgagattcacagccgctttgcggcgcatctgtgcggcgcgctgcacctgacgcgcgcctctgcaccgctgttcgtcgatccgaaatcagggctgaacgacgatctcaacggcgttgagcgtccagtttcgttcgacatcaaggagacaggcaagattgcacaggtcgtccactctctggcgaaatggaagcgcatggcgctttaccgctacggattccagcccgggttcgggctgtataccgaaatgaacgctatccgccgcgacgaggagctggataacctgcattcgatctatgtcgatcagtgggattgggaaaaggtgatcgaccgcgaacaccgcacgcaggtttatttaaaggcgacggtgcaaaagattgtgggcgcgatctgcgacacgcttgacgagctgaaggaagattacccgtcgctgcgcaccgagctttcacgcgatgtcagttttgtgaccacgcaggaattggaggatctttatccaggtttttccccgaaggaacgcgaaaacgcttatttaaaagagcaccgcacggcctttgtcatgcagatcggcgatttgctcaaatctgggcttaaacacgacggccgcgcgcccgactatgacgactggaagctcaatggcgatattgtgttctggagcgacgtgctgggatgtgcatttgaggtttcgtcgatgggcatccgcgtggacgcgcagtcgatggacgaacagctttccaaggcgtgcgccgacgaacggcgcgggctgccatttcacaggatggtgatggacggcacgctcccgctgacgatgggcggcgggattggccagtcgaggctgtcgatgctgctgcttggcaaggcgcatatcggcgaggtgcaggcatcgctttgggacgatgatacggtcacggcatgcgaacgggcaggtgtcacgctgctgtaatcattttcgattaagtcagggaggcggagatataatgtatgacaatcataatggcaatttgaaccgtgttccggatctgttcgggagcatggtgttcggcgacaaggccatgcgcgagcgtctgccaaaggaggtttaccgcgcgctgcgcaagacgattgaaaacggaaagagccttgataaaagcattgcagacacagtggccaatgcgatgaaggattgggcggccgaacggggcgcgacgcattttacacactggttccagccgatgacggggatcacggctgaaaagcacgacagctttatttctccggagggcgacgggcggatcattatggagttttccgggaaagaacttgtcaagggcgaaccggacgcgtcgagctttccgtccggtggtctgcgcgcgacctttgaggcgcgcggctataccgcgtgggacccgtcgtcctatgcgttcatcaaggatcacacgctgtgcattccgacggttttttattcctatacgggcgttgcgctcgataaaaaaacgccgctcctgcgctcgatggaggcccttaacaaacaggccctgcgcatcctgcgtctgtttggaaacggggacgtcacacatgtcaatacgacggttggaccggaacaggaatactttcttgttgaccgcgagcagtaccgcaggcgcgaggacctgattctctgcggacgtacgctgttcggcgcaaagccgccgaaggggcaggagctggaggaccattatttcggctcgatcaaaccgcgtgtcaccgcctttatggaggagctggacgaggagctgtggaagcttggcgtatttgccaagacggagcacaatgaggttgcgccggcacagcatgagctggcgccgatcttcacaaacacaaacctggcgtccgatcacaaccagttgatgatggagctgatgaagcgcatcgccgagcgccacggcatggcgtgcctgctgcatgaaaagccgtttgccggcgtcaatggaagcggcaagcacaacaactggtcgatctgcacaaacacgggcgtcaatctgttggagccgggcgattcgccgcaggaaaacgcacagtttctgctgtttctgaccgcggtgattaaggcggtggatgaataccaggatctattgcgcgtatccgttgccagcgcgggaaacgaccaccgccttggcgcgaacgaggcgccgccggccatcgtttcaatgtttttgggcgacgagctgaccggtatccttgaggcaatcgagcatgaaacgccgtacagcccgcgtgaaacagaggtcatgaaggtcggcgtgcacatcctgccgcgtttcccgaaggataccacggaccgcaaccgcacgtcgccgttcgcattcaccggcaacaaatttgaattccgcatgctcggttcggcattttccatctccgggccgaatgtggtgctcaatacgattgtagcggaggagctggcgcagtttgccgacgcgctggagggaacggccgattttaacagcgatctcaacgcgctgatccgcaaaacactcacagaccataagcgcattatttttaatggcaataactattctgatgaatgggtggctgaggccgaacgccgcggattgtcaaaccttaagacaacggttgacgcgctgccgagctttatcgcgcccaagagcatcgcgctgtttacgcgccacaagattttcacagaacaggagatgcgctcccgttatgaaatcctgttggaaagttactgcaagacactcaatatcgaggcgctgacgatggccgacatggtcaataaacaaatcctgccggctgtcatgaagtatacaaaccgcctggtccgcgcggcgcttgacaaacgcgccttgtgcgacagtatgccggctgaaccggaacagccgcttgcggaaaaactagcggggctgtccggctgcctttaccgcaagacgcgcaagctcgaatcggagcttatgcaggctccggagcaggcggatatcaaagcgcaggccgattattataaagatatcatcctgccgtccatgcaggaactgcgcgagacggccgacgagcttgaaacgctcacggcgaaggactgctggccgtatccgagctacagcgagctgctgtatccggtggactgaaccgcgaccgcttctttgctccgctatatagaaagaagcaatgccgccaggcccgattgtgcgggcctggcggcattgctttttgtctgccggtttgaacgcaggaaggtatcagccgacatcatagagacgcttctccagccaggcgtgcagcgcctgacggctctgttcatcaagtgcggcgcgcggtgcacgcacagtgggcgccgcaacgcagcggggcgaagacgaagcatttgttcccgccgccgcagactcgtcaggcgcacatcgaccggacatatgttgggcacagtgcagagccgccgcagacgcagggacgggctgctcgacgatgcgggaaggccgctcgttggcctcgcgctcattgacggcgaccggatcgaggttatacatgtggtcgtgctcgatatggtagacctcatgctgcagcgctgcttcctggacctcgggtggcagggcggcgttgatatagactgaaaacgtgccgtcagggttcggcgtcgtgacgccgcgcaccgtgagcggcaggttatgcaggcggcggacgaaaatggttccgtcggtcatgaacgtccttcttcctctttctttaaggcttcaatgatagcgaccgcccgcatgacatcctcgcgggtggcatttttgcttacggagaacagcatgcgcagttcggagcggtttttcagctcctcgagatactgcgcgaggccatcgtcatccgtctgtgtgtcaggctttggatattttggaacatcgtaccccatcagccactgtggatcgacgccaaagcggacggcaagtgattggaccgtggggattttgggcgccatcagaccgttggcatagcggctgattgtgccgggcgacatggacagcgcagcggcgatggaataggtcgtttcgccggatgtgcgcagaagctcggaaaaccgctggccgaacagggctttgtcgacggttcgtttttccataaggacacctcactttaaagccagtataacatgattgtattgcaaaatgcaacattttttaaaattattgcgaaaagcattgattttattagaaaagtatgatacgcttatattgcaaaacgcagcaaagcttataatattgtgttgattcaaattatttttttaatttttagttgcgtttcgcaataaggaggggtgaaatgtaccagaaaaagcacaggacagcctccgacatacagggacgaggcggaaaaacaaatcaggaaaaaaaggcatacttgggacaataccgtgcgaatgagtgggagatacggcgcttacaggatgaattggctgatatacgcgcgcaggaacagcggctggaccgcctgttcggcggcgcatcctatgcagggatgcgctctctggacgaacttgatatgcgtatccgcgaatgtctgcatgagcatgtggcgctgcgcgacgagatagaagcgacgatccggacggttcccgaggaacggctgcgcacgctgctccgttttcgccacatcaacggctggacgcttgaacgcattgccggcgagatgaattacagctatatgcagatttgccgcctgcacggaaaggcgttgtccgaaatgatgctgtgaagcaggatgcagcgagcgtaaaatagtgaaattgcaaaatatccgcacggaaaggaggtgttttttctgaagggcatggatcagttcgatataacccaattgtgacactgtaaggctccatgcgaacgattttgcaggcgtggggccgtgcaatccgagggagggaaatgtatgaaaatcaattggaaggtacgtattaaaaatccgctatggtgggtacaggcggcgggggcgctggtgctgccggtactcgcatatttcggcctggcttgggaggatatgacctcctggggcgcgctgtgggatgtgttcctgcgcgcggtgcagaatcccgttgtgctgcttgctgctgcggtcagcgtgtttaacgctgtgaccgacccgacgacggccggcgtcggggacagccggcgggcgctcggatataagactccgaatcgtgacaaatgaagtcggtcaatgcggattgcggcttctaaaaaaggcagcgcatggtaaaataaccgctctgcggttattttaccggtttatggccagggcgatacgcgtgcgcggcccgctgccgctctgatgcccaattttaccatgccgcttcgcagacatggtaaaatgataatgctggcgctgttgcaaacggcaggcggttaagccttgccctgaaagggggcgttgcatatggactatggttggatcatccttgtgctgattttagtcacaggttacataattgcaataaaaaagattagccgccttcactccaatgacgcggctaatctttagctaaactcttgggggctaaccgtcagtcgacagcgccgcattatttttattatatccgtccaggaaacgcctgtcaagttgttgctggccttttgatcaatggtttaatcaacagaagccgcagggattttgattaaaggggcgtcagaagttgagcgggcggcatacctgtcacttggccgatacggtccaggatttccaggtttgtatggacctctgcgcgttcgatttcagcgtagcttttcacgctgagatcgatttgaaacgccatctcctcctggctgatccgcttctccgcgcgaaattccaaaaggttacacgctaaaatgactctggattcatcgtacttcataattacttcctcctgtctgctgtgcaacagtttatggaaataattgtatgaatcagccgcattttatcacaagggtgtcaacactcttgacaaattaattatagtataaaaattaactaaattatactttaaaattgtacttatatgtatttttttatgacacttccggggcttgtttaaaaatagaaaattgccggaatgttcgcaaacagcaagcgaatgcaaagcggaaaacgcaagaagcctttagatttcgaagcttttaacacagcatttaccactgtttgcagaaaaatacgagtagtttgatttttcaaacagcctctaatgtggggggattgagaaatgggagaagtcatcaaaggtattgatatttcatcgcatcagggagaaattgattttgagcgcgtgaaggcggacggcgtgcgctttgtgatcatcaaagccggacagggccttcgtgagatggggacgtttcgtcaaaaatacctgcccgctgtgctggccgcggggcttgactggggcgcgtactggtggagcgacgccgtgacggccgccgaagcgcaaaaggaggcggcggcattcgtcaaggcgctcgacggcctgcgcccgacctatccggtgtatatggaccaggaatacgaatctccctgcggtaacgcctggggagtgggcaagggaaagcagcttcgcaccgacatggcaaaggcgttcctgaaggttctggaggatgccgggtactacgcggggctgtacgcctcgacaaactggctgcaatactgggtggacgacagacagctcatggcttatgacaagtgggttgcacagtacgccgaaaaatgcacctatactggcagctatgggatgtggcagcatcatggagacgcgcggggctttgtagggcatgtggacggcatttccgtaccggtcgatatcaacgcctgctatcgggattatccggagatcatcaaggcaaacctgctcaatggctggacgcgcggggataagccggatactccgggaaacgggatgatcccaattcgcgcgtctgagctgacaagcttgcgtgacagcctgacagcggcgcttgattcggtgaaacggatgctgggggagctggggcatggagctgcttgaacggtttgttccgttacttgtcgcagtgctgacggcggtgactccaatagtgctggcgattcattcaagcggccgaaaagaccgcgcgcagggaaaggaaaattcagaaaagctgtgcggcgcggtcgaatcgctcaaggacagtattgaccggatggatacgcgcattgaaatcctggaaacacatgcgcaggaggaccacaggcggctgctcgtcatggaaatcctggaggaaaagctgccgattgaggagcggctgcgtgccggagaaaaatatgtggccgctgggtggaacggatcgatcaaggcaaagtaccagatgttgttggaggagtaccggcgcaagcagaaggaataacacacaataaaagaggggggcgcccagcgggcgtccccctcttttattggaacgttcggctatactccggcgtttttcattgcaaagcctgtggctttgtgatatcatcataaccgcggcaaacggttgaaaaagcctgtagatttggaggaatcacggtgaaagaaggcgcgattgaaatccggggcctcgacttttttagaagcggaaatgtgttcacaggcagcgttggcgaattccggttccggatttcgcccgaggatggcgcgctgaaagcatacgcttaccggacctactgctttgaaaaggcgcaggatgtgcgctccgaagcattttctctcgatgagtatggattggagcagttgaccaaatggttggagcagcagtgcgatgctttgattaagtaaagctgtaaatatgtggctatgacacaaaaatcagtgccatcaggagggttttagttgtgctttgtatgcagcctatgggcgctttggacaaaggatgctttaaaagttttctgataagaataggaaaataatagaaaaagggactgcgatttgcgctgttttgtgttacaattatcacaggaaaagattcggacagcccggagtggcggcggagcaagagcggacgctcccgacgttttacagcgtgggtttgaaagtgaaaaatctgccatcagccgcgcgaccggcggacacgcctttgaaacgcgggcctgaaggcccggcataaagaatgattcggggtggatgtcacaatgagcagacagacctgcaacatatgcccgcaccactgcacgcttgaggagggggagagcgggtactgctgtgcgcggagcaaccacgatggcgagatccgcaacgataattacggcatggtcacgctgctttctctggaccagatcgaaaaaaatccctgcgccggttttatccgggcagccgggttctttccgtgggcagttacggctgtaatctgcgctgcccattttgccagaattatgccatttccatggccgatgggatgcacgcaggcgcgcagtatatcccgccggaggatctggtgcggcgcgccggggagtatgaaccggcaggcaatattggacttgcattcacatacaatgagccggtggtcggttatgaatatgtgcgcgattgtgcgcggcttgcagcaaggcgggggtttcatacagttcttgccacaaacggttacatctgtgaacagccgttgggcgagctgctgccgtatatcaatgcgatgtgcatcgatttgaagggcttttcagaggcgtcgtacagccgccttggcggcgatctgaaaactgtgtgttccaccattgagacggcggcgcgctgctgccatgtggaggtgacggtactggtgatccccagggaaaacgacactcccggccagatgcgccgcctatcgtcatggctggcggggatcagcccggagattgcgctgcatatcaaccgcttttttccgcattttcacatggcggaccgcgaggccacgccggtcgatgttgtgttttcactcgcggatgtggcgcgccgggcgcttccatatgtctatgtgggaagctgttagagcaaataaacaggattgtaaataaaaatctgtattcacagccggaggatgctggacaggcaaaagacctgcccaaactgcgcttgccgactgtgaatatgggttttaagatacgggaggcattaaaatgctggaagaaatcaaagagcaagcccgcgccgcagtattggaattgctggagtcagcgcgtctttcacgcggtgatatccttgttgttggctgttcgtcgagcgaggtaatgggcgggcgtatcggcgccgcatcgagcacgcaagcggcggcggctgtgttcgcggggatttatcctgtgctttgccaaaatgggatttatcttgcggcgcagtgctgcgagcacctcaaccgggcgttggttgtggagcgggcgcttgtgcgggcctatggccttgacgaagtaaacgccgtgccgcagcccaaggctggcggctcgtttgccacagaggcgtatcaggcgtttgccgcgccggctgttgtggaacatctacgcgcgcacgccggtattgatatcggggataccttgattgggatgcatctgcgcgaggttgcggttccattgcggttgtctgtacgcacgatcgggcaggcgcatgtcgtctgcgcacgcacgaggcccaaatatatcggcggcgtccgcgcgcattataacgacgcgctgctttgaatggcgcacaggaggggcggccgccgaagatgcgggccgcttttggtcctttttttcccatttaagcttgacaaatgttgttccctgtgatatcatcaactacacaacaagatgactctcaggggagtagtcggcgcgacaggcgcagttgaatcaacatcacgggctgtttggccatggttcagcttgaaatgacaagacctgtgtttttccaaagcggagaaacgcgggtcttttcgtttgcacatttggggtatactgaatgacaaaaggaaggtgcagtttatggaatttctgttgtccggcattttggcggtcacatggcggcaggcggtgatgtatgtaatcggcggcgtgctgatctggctcgcggtgaaaaagggatttgagccggccctgctgctgccgatggggtttggttccattctggtcaatctgccgttttccggggcgctcgatcagatgcttcaaggcgggattgaatcgcacggcatcatccagtggctgtttgaaacgacgatccaggcgtccgaggcgatgccgattctgttatttatcggcatcggcgccatgatcgatttcgggccgctactgtcaaatccgcgcatgatgatcttcggcgcggccgcccagttcggcgtctttttcgcgttgagcgctacagtgctgctcgcgccgctgttcggacttgatatgacgctcatggacgccgcgtctatcggtgtgatcggcgcggccgacggcccgacggcgattctggtttcacagattttcaattctccctacatgggagcgattgcggtggcagcgtattcctatatggcgttggtgccgattgtgcagccggctgcaatccgtttggtcactaccaaaaaggagcgcatgatccggatgccttataatccgaaaacggtcagccggcgcacgcggattctgtttccgatcatcgtcacaatgatcgccggatttgtcgcgcccacctctgtggcgctcgtcggttttttgatgttcggaaacctgctgcgcgaatgcggcgtgcttgactcgctcgcccagactgcgcgcaatgagtttgcaaatattattacgcttttgctggggcttacgatttccttctccatgcgcgccgaggattttgtgcgcggtgaaacgctgtttatcctgtgcatcggtttaattgcatttgtgatggacacaatcggcggcgtgcttgtcgccaaactgttaaacgtgttttccaagaacaagatcaatccgatgatcggcgcggccggcatctcggcgtttcctatgtcggcccgcgtggtccagagcatggcgacaaaggaggaccgccaaaatcatcttttgatgcacgcaatcggcgccaatgtttccgggcagattggatcggtcatagcgggcggcatcattctgtacctggtgccgcggtttatttgataagggagggaatacaaatatgtttgatgctgcggcagcggcaaatttgattgcgtcgctgaaaattatggggcttggcatgggtgggatcttcgccgtcatgctgattattatgggtgtcgttgccctgctgggacgattcggggcggatgaggaggagccgtccggcaaatcgcagggatgaaaaaaggggcgtcccgcaggacgccctttttttatggcttcgtcagaactttttgcgcagcatggtgaagtcgaagaaatcggtatagaattcaagcgagcgcagcacagggcggctcaagcggcagaagcccacctcgtcgagcataagaagcgcgccgccgtccgggacctgcagcaaccgccggatggcgggcgtggcgtttgttgcgcagacatgcgcgatatcggtgatgacagtcagcccgcagcagcggtcgaggatatcaaagatcggcttggaccagtcgatggccatataatccatgccgtcaaagagcgacagcgcaaggtagtcgatggaatagatgacaggcgtatcgccggccagcacgcgtttttcacagacgatgacgcccgcgcccgcatcgagacgcaatgtttgggccagctcctcgtcggcctgctccacacgcagggacagactgtcactgcgtggactgcggccggcggcgagaatcagttcgttgtactcaaatttcaaatcaagacggcttttgaggttgacaatttcgcggttgatcaccgtgccgatgccgcgcacgcggtcgatcagcccctcgcgttcgagatcggagagcgcgtcgcggatgacggtgcggctgacgcttaggcgctcggccagttccacctccgacggcagacgctccgactgggcgaatacgccgccggtcagctccttgatcagcagggcgctgacctgggtggacatcagcttgccgcccagatgcggcaattcatattccggcatcatcgtattttcagcttctttcatcagggaatagccgcatgcggctgtaagaaattaacaatgcttctgcatatcttttatggaaaatggttcttgttttgtcatggcatttctgataaaatgaatgcggtaataagtatgactaattaattatttgcgaggattttccaataaatggagcgcatgtgcggttgcattgtgcaatggtatgtcttattatactcaaatttttataaaaagacaagcgccgaccgaagaaccaacaggaggaaccggatgaatcacgaaaaaaccttcgccctcaagggtgatattgtttatacagccgctcccggcggatttactgttgtggagcagggctatgccgtctgtgaaaacggccgttcggccggcgtgtttggcaggctgccggagcaatttgacggtatccatgtggaggactgcggacaaaaactgattataccgggattggttgacctgcacctgcatgcgccgcaatattcctttcgtggtcttggcatggatctcgaactgctcgactggctggagacgcacacctttccggaggaggcgaggttttgtgaccttgattacgcaaaacgcgcttacacgctgttcgccgacgcgctgtcgcgcggcgcgacgacgcgtgcctgtgtgttcgcgacggttcatgtgcctgctacgctgtgcctgatggagctgttggagcggacgggtatccgcgcgatggtcggcaaggtcaacatggaccgcaactgtcccgacagcctgcgcgagcaaagcgcggccgtttcgctcggcgagacgcggcgctggctggaaggctgcgccggcaaattcaaaaatgtgtcgcccattctgacgccgcgttttatcccttcgtgcaccgacgagctgatgcgcggattgggcgcgcttcaacaggcgacggggctgccggtgcagtcgcacctgtcggaaaatcattcggaaattgagtgggtgcggcagctctgcccggagtcggctttttacggcgacgcatacgaccggttcgggctgttcggcggcggctgtccgacgattatggcgcattgcgtgcacagctcggccgcggaaatcgatttgatgaagcggcgcggcgtattcatcgcgcactgtgcggcgtcgaacatgaacatctgttcaggcgtcgctccggtgcgcacatatcttgcgcgcgggatgaacgtggggcttggcaccgatgtggccggcggtttctctgattccgtgttccgtgcgatgagcgacgcaatccaggcttcaaagctgcgctggcgcctgacggacgattcgctcgctccgctgaccgtatcggaggcgttttatctcggcacaaagggcggcggcgcgttcttcggcaaggtcggctcgtttgaggcgggatatgaattcgacgcgcttgtcattgacgacgccgggctgccgcatccgcagcccctgacgcctgcagagcggctcgaacgcgtcgtctacctctccgacgaccgccatatcagcggcaagtatgttgcgggcgcgcgcgtgcggtaattaaaccggtatatgcaaagcgcgccatgcggcgcgcttcacataaaagggtgtcagcgaagcgccgccgctgtccaaggcgcggctttgccaacgcccggtcagggcagacacgcagaaaagcggcttttcgtgcgccaacggctgccggcggaaaacaggcggccgttgacgcgcggacaacgaaaggaggaggaatccggcatggcacagacaaacggtcaggggacactggagcgtttcttcaagctgaaggaacacaacacaaccgtccgcacagaggtggtggcgggcattacgacgtttgtggcgatggcgtatatcctagtggtcaacccgcagatgctcgcggacccgttttacatcatggagcagccggaatatgcggcgcaggtggcaaacggcgtcttttttgccacatgtctgatcgcgttttttggcacgtttttgatgtcggtctatgcgaaaatcccgtttgcacaggcgcccggcatggggctgaacgcattttttgcgtatacggttgtgctcggtatgggatacacttatgggcaggcgcttgcgatcgtttttatctccggaattctgtttatcgtgattacagcgatcggcttccgcgaggcgtgtgtgcgcgcgatcccgccgtgtgtgcgcggcgcgatcagcgccggaatcggcctgttccttgcgctgatcgggctgaaaaacgcggggctggtcgtttcaaacagctcgacgcttgtggcgctgatcgacttttccaaatggggcgacccggaactgcacgggctggtggcgtcggcgctggtggcgcttgtcgggctggttgtgatcggcgcgctgcacgcgcgcaggatcaaaggctcgattatcatcggcatcctggtggcgacaatcgtcggcgtcccgctcggcgtgacctcgttcggcggattttccatgaacatcggacagcagttctccgattttgtggatgtgtcgctgttcaaaatggatttcgcgggcctgttcgctgattccgccaatgtattccaaatggtgttcacactggtgatgatcgtcatatcgttttcgcttgtcgatatgtttgatacaatcggcacgctgctcggtacggccaaacaggcgaatatgctcgatcaaaacggcgatatgccgcgtatgcgtcaggcgatgatggccgacgcgctcgcgacgaccgtcggcgcgtgcctcggttcgtccacagcgacgacgtttgtcgaatcgagcaccggtatcgctgagggcggccgcacggggctgacctctctggtcacgtcgctgctgtttctcgcgtcgatcattatcgcgccgatcgtgggcatcgtgccgggcgcggcgaccgcgccggcgctgatttttgtgggcgttttgatgatgggttcaatcaaagagcttgactttacggatatgtccgaggccattccgtcgtttgtgaccgttacgttcatgccattcacctattcaattgctaacggcattgcgttcggtctgatcacctatgtgctgatcaagctgctctccggcaaggcgcgtgaaatcaggccgtttacggttgtgctgtgcctgctgtttgtgctgcgttttgcgtttatgaccaccggctgatcctgtccgcccgcgcccgtgtaaatacgggcgcgggtgttgtgctttttttggaaaagtgcttgcgcatccggtgcgggcatggtatacttgtaaaaatttaaaagtatgacttatgactaacggagcatacaaaacgaatcaagtggataagggggcttgtcaaatgggagtcggcagcagggccatccgcgtggatgcatgcgagaaggtgaccggcggggccaaatatacggatgatttgcgaccggcaaactgcctggttgcaaaggtggtgcgcagcaccgtggccaacgggcgcgtcaaggcgtttgatctggcgtccgcgctggcggtaccgggcgttgtaaagatcgtcacctgcttcgacgcgccgccgtttgaattcccgacggcggggcatccatggtcgaccgaaacggcgcatcaggatgtcgccgaccggcggctgctcaacgagcgcgtgcgtatctggggcgacgatatcgctgctgtcatcgctgaaaacgaggtggccgccgtgcgcgccgcgcggctggtgcgtgtggagtatgaggaataccccgtcgtgctcacgccgcaggaggcgatggcgcccggcgcgccggtcctgcacgacgcgcgcccggacaatgtgctggcgcacacaagctttaaaattggcgagggcagctatgaggaagcggcggccgcgcccgggctgcgcgtcgtcgaggggacgtatgagacgcagactgtccagcattgccacatcgaggagcctgtctgctatgcatacatggagaaagggcgcgtcgttgtagtttcgtcgacgcagatcccgcatattgtgcggcgcgtatgcagccaggcgacgggccttccgtttggtaaaatccgcgtcgtcaagccgtatattggcggcggcttcggcaacaagcaggaggttctgtatgaaccgctggcggcgtttttaacgatgcaggccggcggccgtccggtggaaatcgagctgtcgcgcgaggagacgtttgcatttacccgcgtgcgccatgcaatcgatttttcgctcaagacagccgtgcggcccgacggacggcttgtcgcgcgccgttatgaagcgtattccaatcagggcggctacgcctcgcacggccattcgatcgctgcgaacgcttcaaatgcgtaccggcatctctatcaggacgaacaggtgctcgacgccgatacatacaccgtttatacgaatatcgcgtccggcggcgcgatgcgcggctacggcatcccgcaggtcaattttgcgatggaggcgcacatggacgatgtggcgcgcgcaatcggcatggacccgatcgacctgcgtgtgaaaaactgtatgcgccagggctatgtcgatccgggtacgggcatcacctgctatacaagcggcctgcttggctgtctcgatcaagggaaaaaatacatcggatgggatgagaagcgcaaggcatacgccaatcagacgggcaatgtgcgccgcggcgtcggcatggcaatgttcagctacaagacgggcgtttatccgatttcactggagacggcgagcgcgcgcctggtgctcaaccaggatggtacggcgcagctccagatgggggcgaccgaaatcgggcagggcgcggacacggtgttcacacagatggcggcggagacgatcggttttcgcgacgaggatatccatatcgtatcgacgcaggacacagacgtgacgccgttcgacaccggcgcgtatgcgtcgcgccagacgtatgtcagcggcatggctctgaaaaagacggcgaaggtattccgcacgcggattctcgactatgccgaatatatgctcaagcgcggcgccgacaccatggatatccgcgagagctggatcgttgacgccgaaagcggcgaacgtctgctttccatgtccgatctcgcaatcgaatcgttttacagcctgaccaattcggtgcatatcaccgctgaggagacgaatcactgcaagagcaacacgttttcgtttggcgcgtgctttgcagagatcgaggtcgatatcccgcttggcaaaatcgaggtgctcgatatcatcaatgtgcatgacagtggaatgctgatcaacccggccctggccgaggcgcaggtccacggcggcatgagcatgggccttggctacgcgcttggcgaacagctccgctacgatgcgaaggggcggccgctcaacaacaacctgctcgactacaagctgcccacctcaatggacacgccggagctgcacgccgcgttcgtcgagacggacgacccgagcgcgccgtatggcaacaaatcgctcggcgagccgccggcaatcccggtggctccggcgatccgcaacgcgctgctgcacgcgacaggcgtcgcggtcaacagcctgccgctcaatccgcagaagctggtcgaggcgttcgcggccgcgggcatgattgcatcctgggagggctgagagatgtacgatattgaaaagatttatcaggccaaggacgttcccgacgcgatcgcggcgcttgcggccgccccggacgcggttgtgatctgcggcggcagcgacgtgcttgtcaaaatccgcgagggcaagctggccggatgttcgcttgtgagcatccacggactaaaggagcttgcgggcgtgcgcatggaggacgacgggaccatcgtcatcggcccggccacgacattcgcgcatgtgacgcgcgatccgatcatcgagcgccaccttcccgcgctcggcgcggcggtcgaccaggcgggcgggccgcagttgcgcaacgtcggcaccatcggcggcaacgtctgcaacggtgtgacgagcgccgacagcgcctccacgctgctgactctcaacgcgcttttggagctgactggcccggacggcaggcgcacggtcccgctctgcgatttttaccgcggcccgggaaaggtcgatctggcgcacggcgagctgttgacggccatccgcgtcgcaaaggccgactacgaggggttcggcggccattacatcaaatatgcgcagcgcaacgcgatggatatcgcgacgctcggctgcgcggtccatgtgaagctcgacgcagagaagcgcgccgttgaggagttgcggctcgcattcggcgtcgccgcgccgacgccggtgcgctgccgcgcggccgagcaggcggcgcgcggcaaagccgtttcgccggagctgttcgacgcggtgagcgaagccgccgcgggcgaggtcaacccgcgcacgagctggcgcgcgtcgcgcgcgtttcggatgcagcttgtgcgggaattgagccggcgcgcgctcaaacaggcgattatacatgcgggaggtgctgtgacatgctgaagctgatcaaaatgaccgtcaacggcaaggaagttgaaacggctgtcgatccgcgcgaaagcctgctcgatacgctgcgcaaccgtttggggcttacgagcgtcaagcgcggctgcgaggttggagaatgcggcgcgtgcacggtgcttgtcgacggcgaggcgatcgatagctgcatctatctggccgtctgggccgagggcaggacaattctgaccgtcgaggggctgcgcggcccaaacggcgagctgtcgccgatccagcaggcgtttatcgaggaggcggccgtacagtgcggcttctgtacgccggggctgatcatgacggccgtggagattgtcggcagcgggaaacggtacacgcgcgaggagctgcgcaagcagatttccgggcatctctgccgctgcacgggatatcagaacatcttaaacgcgatggaacgcatcgtcaacgagacatacaaggccgtcggtcaggactgatccgccggacagacagaagcaggccccgtgccggcgctgatagcgccggcacggggcctgctgttttttcggatcacgtcgcttcgcgtgggttgataaagacccccgacttgccgccgcttttttcggcgagatggatttcgccgatctccatggcgcggtcgatggccttgcacatgtcgtaaatggtgagcagcgccgttgaaacgccggtgagcgcctccatctccacgccggttttgccgctgacctgcgccgtgcagattgcttcgacggccggcaggtcgggatggagcttgaaatcgacagtacatttcgtcagcatcagcggatggcacagcgggatcagctcgctggtgcgcttggccgccatgatgcccgccacgcgcgcgacgccgagcacgtcgccctttttggccgtgccgccggcgatggcgtcaaaggtcgcccgctgcatccggattataccctttgccacagcgacgcggtcggtgatttccttgccgcccacgtcgaccatcacggcgttgccctgcgcgtcgatgtgtgtaagccccgccatcagacgccgccccttccaaagccgcagttcggaaagtggcacggctcgcagccgagacaaagcccgccgtttccaagccgcgcgagatcgcgttttgtcaccgggctgtcggccatgacgcgcgggagcaccaggtcgaaaattgtgcgcttggcatacatgacgcagcctggcaggcccatgacgggctttccgtcaagataggcgagcaggaacatcgcgccgggcaggaccggcgcgccgtagctgacgatcttggcgcccgtcgcgcggatggcggcgggggtgcggtcgtctgggtcgacgctcatgccgcccgtgcagacgacaagatcggctccgtccgcaaaaaacgcgcggatagcggcggtgataccctctggctcgtcgccgcacagcgtgacgcccatgatctcgccgccgaaggcttcaagcttctgcgcgacgaccggtgaaaaggtgtccttgatgcggccgaaaaagacttcgttgcccgtggtgacgatgccgcagcgttttttatggtacggcaggacccgcatgagcggacgctcccctgcgatgcgccgcgcctcgttcattttttcctcggaaatgacaagcgggatcacgcgcatccccgcaagcttgtcgcccttctgtacgggcgtgtggttgccccgcgcggcaatcatgatttcatccagggcgttgatttcgtcaaggcgttcgacgtcgatttcaaacaggccgtcgcaatcggcggacagctcgattttgccctccttgacggacgattcgttcatgtgatcatttttgcacaggccgcacaggatgcgcgcaccgtcgttttcgtggagcatccctgcctgcttctcccagatatagatgtaatccttgcccatggagagcagcaccgggatatcctcctcggtgacaatatggcccttgcgaaaccgcgcgtcctttgtgacgcctttgatgatctgtgtcatatcatggcagagcacctgtccgaccgcgtcctgcgtcctgatctttttcatccgccgtccctctttcaaagcgtagtgtttttaaaaatagttcgcaagatcattctaccatgatccgaaaaaatgtcaatcgcgcgccttgccgaaagcgcatcggcgcggtaaaatagaggtgtgggaacgtcggcgtgcgggcagcgggggaggggctggttgaaaaatcaaaattaccgtctttttctgcaaacagcggcgaatgctgttaaaaaagcctcgcaatccgaaaggattcctgcgttttttgccttgacttcttctgccgcctgcaaaaaatccggcgattcctatattatacaagcctcaggcgaaggcggaagcatattcatgtgggatgtcaattgtgaaaaataaccaaattctggactgatatttttttatcgaacttttcaaatccggttgtaactttctcgcgcttgcggtatcataagggcaaggtccaataaaaaatataaggccaaaaaaatttttgtgaggaagttgcggctatgagtgaaatcagtaaaggtacaagaggctccgtattcgaattgacgggcgtgccgccggccgggcaggtgcttccgctcgggctccagcatgtcgtcgcggcgattgtcggcgtcgtgacgccggcgatccttgtatccaacacggttggtcttgacagcgccgacaaaaccatcctgattcaggtttcccttttgatcacggcgatcgccaccctgatacaggtgtttggaaacgggcgtgtcggcgcggggctgccggtcatcatgggcatcagcttcgcctacgtgccgacgctgctggccatcggcggacagttcgatctgccgactatcctcggcgctgagatcgtgggcggctgtgtcgcgattgtattcggcatatttgtcaaatatctgcgcgtgtttttcccgccgcttgtaaccggaacggtcatctttacaatcggcctttcgctttacccgacggccgtcaagtatatggccggcggcgccggcagcgagggcttcggctcgtggcagaactggacggttgcgctgattacgctggcggtcgtcatcttctgcaaccactttacaaaaggcgttttcaagctggcgtccatcctgatcggtatggtggtcggctatattgtggcgctggcgatgggtatggtttccttttcggccgtcgcccagtccggttggtttgctgtcacagctccgctgcatttcggcatcaccttcaatgcgagcgcctgcatttcgctggcggtcatgtacattgtcaattccgtccagacaatcggcgatctgacttcgacgacgatcggcgggcttgaccgcgagccgacggaccgcgagctttccggcggcatcgttgcccagggcgtcatgagcgttgccggtgcattttttggcggcctgccggctgcaacgttcagccagaacgtgggaattgtgacagtcaaccgcgtcgtcaaccggattgtgttcgcatttgcggcgtgcgtgctgctcgtagcaggctttgtgccgaagttcgcgtcgctgctgacaacgattccgcagtgcgtcatcggcggcgcgaccatctcggtgttcgccaccatcacgatgacaggcatccgtatgatcacctctgcaaagctgacacagcgcaatgttgcaattgtcggcctgtcggtggcgctcggcgtcggcgtgaccacggtagaaggctgtctgtccgggttcccgagctgggttgcgacggtgttcggcagctcctcagttgtcatcgcgacgctgatggcgattttcctcaacctcattctgcccaaagaatccggacagaatcaataaatttggagcctgtattaagatcccatccgcttgaggtttttggccggcggtttccgggagcgcccttgcaggctcccggaagggatggctgcttttgcatgaattggtcgcggcgtatctgccgctggtggattttctggccgattgcctaggagagaatacggaagtcgtgctgcatgacctgtccgattggcaccgttcagttgtggccatccgcaacgggcatatcagcgggcgcgaaatcggctcgcccgtcacggatctggcgctgaaaattttaaaaacaacggcgtttgacgagcggccgcatctggccaattaccacggcgtcgcgaaaaacggcaacccgcttcgttcatcgacccttttcattcgggacaagggcggcgagccggttggaatgctctgcatcaacagcgattgtcacagcctgctgcaggcccgcgacgcgctcgccgcattcatcgcggggatcggcctgcatgcggacgcgtccatcacggagagcttccatatgagcgtggaggagctggtgcgttcaaatctgcggcgcgtctgcccgcagatcgagctgcggatcgacacgctcagccagaaggaaaagctggagattgtagaagggctggatgagctggggaccttcctggtcaagggcgcgattgtttacgcagccgagagcctgaacgtttcggtgcctacgctttaccgctacctcaataccatccgcaaataagatgccaggcggcccccgctgtgcgggaaccgcctggcggacagcaagttcagggattcgttaagcttcttttgtggcatcaatgtagctgtaaagcgtatacttggagatgccgaagtatttggacactttgtcgccgcttttggtgatcaaaaacgcgccggtatcgttgagaaagcggagggccttgattttatcctccttgcccataagcgcaaccggtttgccgacaaggcgcacgctctgctcgatcagactgtcgagcagctcattgacgttttgagtgatgcgttcaggctctttttcgccgggctgctcgatggagatcagcggcttgatggcgttttcgatcagcagaagattggtgatgtcgtaattgatggaaaaaatgccgatggcgtcgccgttttcatcacggatatagatggtgctcgatttaaggatgcgcccatcgcgcgttttggtcagataattgaggtgatccttcaggttgctgcggtcgccgtgcagggcctcgagcacaacgtgcgaaggcccgtcgccgagcttgcggttggtgacatggccgttttcgatcgctacgatcgagctgtcgacgttgttgtcggtcaggtcgtgaacaacgacctcgcagcagttgccgaactgctgcgagattccgcgcgcgagctgccgcaggaaggtaagcgttgtttgttccagcataggcactccttcaaagcatttacgcttgaaatagtattttaagatactgttatcataccaagcgtccggtaaaatttcaataaaaagttgaccaatcaaaaaaattttttgagaaaaaacaatagaaggcttgcattttacagccgtccatggtaaactaaaattattaaaaacaaattgattattctgtatagtttgtggaatagtcggtctgttttttataaaaagcatattgtatgttggctgcaacggagtgcttcgcgcacgggccggatggacgcacaatcgggctgcgtgcctgggtccgccggtatggcaaagagcggcgacgggcgtccattcagggaatgggcgcccgttttaatgtgggcggacacaatcaggggaggtaaaaaccatgctgcttattggaaacggaaggctgatcacccgcggagaacacaaccgcctgatcgaaaacggctgtgtcgcggccgacggcagcgttatcgccgccgtcggtacaaccgatgagctgcgccggcactggcccggcgcccagttcatcgacgcgcacggcgggatgatcctgccggggctgattaacgcccacaaccacatctacagcgccttttcgcgcggcatcgcgatcaacggctataacccgcacaacttccttgacatcctcgacggcatgtggtggacgatcgaccgcaacctgcttttggaggacacgcgctacagcgcgctggcaacgtatatcgactgtgtcaagtgcggcgtgacaacggtgttcgaccaccacgccagcttcggcgagatccccggcagcctgttcgcaatcgcggacgccgccagtgagatcggcgtgcgcacctgtctgtgctatgaggtgtccgaccgtgacggagaggaaaagatgcgccaggctgtccgcgaaaatgccgatttcatcgcccactgcaagaaggacacgaccggcatggtcaggggcatgatgggtatgcacgcgtcgttcacactctccgacgcgacgctcgccctctgccgtgagcatacgccgtccgatatcggcttccatatccatgtggcggaggggatggcagacgtctacgactcactgaaaaaatatggaaaacgcgtcatcaaccggctgtatgacaacgatatcctcggtgaaaagacgattaccggccactgtatccacatcaacggcatcgagatggatattttaaaggaaacgaacacgatggtcgtacataatccggaatcgaacatgggcaacgctgtcggctgcccgccgacaatggagatgatccgccgcggcctgctggtcgggcttgggacagacggctacacgaacgatatgtatgaatcgatgaaggctgcaaactgcctgcataagcacaacctctgcgacccgaccgccgcctggggagaggtgccgtatatgctgttcgagggcaatccggccatcggcgcgcgttacttcgacaagaagctcggcgtgcttgaggaaggcgccgccgccgacatcatcgtcaccgattacgacccgttgaccccgctgacggccgacaacatcaacggtcacacgctgtttggcatgagcggccggcagaccgtcacgaccgtaatcgacggcaaggtgcgtatgcaggaccgcgagctggtcgacatcgacgaaaagaaaatccttgcggaggcgcgcgcgcatgcgcaggcgatgtggaaccgtatcaactcaaggtaaaattgaccggttatattacgaattggatcgggctgcggccggtcacagacgcaaatgggctgacagaaggccccgcaaaattgggaggaatgatttatgggcgatcgcatgaggccaatcccgtttggcaagctgatggattggatcatcacagaataccagacgcaggggagtattttcggcgtggcgaagctgttccgccaccagtccggcgacaagatgctgccgctgttcggcgagcggatggaggctccgttcgggccggccgccggcccgcatacgcagttggcgcagaacatcgttgcggcctatgccgcgggcagccgtttctttgaattaaaaaccgtgcagcagctcgacggcgaggatctgccggtcgccaagccgtgcatcaacgcggaggatgaatgctacaatgtcgaatggtcgaccgagctgcgcgtaccggaggcatacgctgaatatgtcaaggcgtggtttgcgctcaagctgatttcccgcgcgttcggtctgggagacgaatgcggcttcatctttaacatgagcgtcgggtacgatctggaggggataaaatccccgaagatcgacgcgttcatcgaagggctgaaggacgcgtccgtgtcgccggtgtgggcagagtgtaaagcctgggcgcttgacaatcttgcgcgcctgccgcgcattgacgccgcgtttgtcgaagcggttacgccgcatatctgtacgtcgatcactctgtcgacgctgcacggctgcccgccgcaggagatcgagcgcatcgcaacgtacctgctgacggaaaagaggctaaacacctatatcaagtgcaatccgacgctgcttggatatgaatacgcgcgccagacgatggatgcgcttggatttgattacatcgcgtttgacgaccatcatttcaaggaggacctccagtttgccgacgccgtgccgatgatccggcgtctccaggcgttggccgacgggaaggggctgaccttcggcgttaagctgacaaataccttcccggtcgatatcgccgccggcgagctgcccggaaacgaaatgtacatgtcgggccggtcgctttatccgctgacgatctccgtcgccaagcttctttccaaggagtttgacggcaagctgcgcatctcctattccggcggggcggatgcctacaatattgaaaagctgtttgcggcggggatttggccgatcacactggccacgacgcttttaaaacccggcggctaccagcgtctttaccagctcgcggaaaagctttataactgcggcgatcagccgttttcgggcgtgcatgtggccaaggtgtgcgagtttgtcgaggacgcgatgactgacccgtattaccgcaagccggtcaagccactgcccggccgcaagatggaccggaaagtccctcttatcgactgtttcgaggcgccgtgccgttccggctgcccgattgagcaggatatcccggcgtatctgcgtctggcggggcagggaaactatctggaggcgctgcgcgtcatcaccgcgcgcaatccgctgccgtttatcaccggcaccatctgcccgcatcactgcgctgacaaatgtacgcgcaatttctatgaggattccatacatattcgcgccgtcaagctggagtgcgcgcagcatgcgttccaggaactgacggcaggcatggagaaggccgctcccacagcgggcgtaaaggccgcgattgtcggcggcgggccggcgggcatcgcggcggcgtattttctggcgcgcgccggcgtgtctgtcaccgtgttcgaaaagcgggagacgctcggcggcattgtgcgccatgtgatcccgtcgttccgaatccctggagatgcgattgaaaacgacgtcgcgctcgcaaaggctgccggcgcgcagtttgtgaccggcgccgaggtcacttctgtcgacgagctgaaggcgaagggctttacgcatgtgatcctcgcggtcggcgcctggaaaccgggcgtgctcaagcttgaatatggcgagccgatgggcgtgctggaatttttaacggcttacaatcgcgcctccgcatcgctttcgctcggtgaaaacgtcgtcgtcatcggcggcggcaacactgcgatggacgccgcgcgcgcggctgtgcgcgtaccgggcgtcaggagggtgcgccttgtttaccgccgcacaaagcgttacatgccggcggacgaggaggagcttgcgctggcgatcgaggacggcgtggagttctgcgagctgctcgcgccggtcggagtgcgcgacggcgtattgacgtgcggccgcatggagcttggcgcgcccgacgcgtccggccgccgcagtccggtcgcgacaggcgagacaatcgaactgccggccgatacggtcatcgcggccgtcggcgagcaggtcgatacggcgttttatgaaaggaacggcatcgccgtcgacgcgcgcggccgcgcgcaatgcgacgctaagacgctggagacgaatgtgaaaaacgtctatgtagcgggcgacgcctaccgcgggcctgccacggttgtcgaggcgattgcagacgcgatgaaggcggtcggcgcgatcgcggacatcgcggcggaccgctgcgcctgcaaaaacgtatccgacgactataaccatgcgcttaaaaagaagggcgctctctatccggagggcgagggctgcacagagccgggccgctgcctggaatgcgcgactgtctgcgaatgctgcgccgatgtctgcccgaatcgcgccaatatcgctgtgcatgtgcctggcaggcgtatgcgccagatcatccacatcgacggcatgtgcaacgagtgcggcaactgcgctacgttctgcccgtatgacagcgcgccctacaaggagaaattcacgctgttctggagcgaggccgactttaacgacagcaaaaatgaaggcttcctgctgctcgacgacgcgcggcagacgtaccgtgtccgcctcgacgggcaggtggccgactatacgctcggcgaatcggacggcggtctgaccgccgatttggccgcgctgatccgggctgcgcgccgcgactacgcgtacctgttttaacaaatcagggcggggcaaagccccgccctgaagcccgttttgaacttcctttcatgcggcggtccaaaattgacgcgcgaaaagccccatagccgctggcggggcttttcgctcctgtttaaagccagcttgcagcggcagaatggagtttgatatgaaaattctgattaaaaacgggcgcgtcgtaacaccgcgcgggacgtgtgcagccgatgtgctgattgagggcagccgcatcgcgcaggtgggggaaggactgtccgaaagcggctgtaatctctatgacgcggccggttgcctgctgttcccgggatttatcgacgcgcatacacatctcgacatggacaacggcgtgactgtatcgtcggacgactttgaaacagggacggcggcggctgtctgcggaggaacgacaaccatccttgatttcgcaacacaggaccgcggcgggacgctggccaaggcgcttgcggactggcatacgaagtccgatggaaaagcgtcgtgcgattatgggttccatatggcaatcaccgattggaacgacgaggtttcacgggagatcgacggcatggcgcaggccggcgtgacgtcgtttaagctctatctggcgtatgacaacctgcgcctgccggacgggcaggtttatgaggtattaaagcgcgtccatcagatcggcggcatcgttggaacacactgtgaaaacggcgatttgatcaatgagctggccggcgagctgcgccgtgcgggcaagctgtcgccgcgttaccacccgttcgcgcgtcctgactatgtcgaggcggaggcgatcgcgcgctattgctatatcgcgctggcggcggacgctccggtcaatatcgtccatctgagcacacgcctgggacttgaggaagcacggcgcgcgcgggcgcgggggcagcaggtgtatattgaaacctgtccgcagtatctcatgcttgatgaatcgctttacgaacagccgggctttgaggcggcaaagtatgtctgttcgccgccgctgcgtacagccgccgaccgtgaggcgctatgggatgccatctcaaacaatgaggtcgacacgatttccacggatcattgcgggtacaatttcaagggacaaaaagagcttggccgagacgacttcatgaaaattccaaatgggatgccgggtgtggagcaccggccggcggtgctctatacatacggcgtcgaagccggccgcatgacagagggccagatggccgccatgctttccgaaaacacggcgcgactgttcggcatgtatccgcaaaaaggcgtcgttgcgccgggcgcggacgccgatatcgttgtgtgggacccatcatacagcggcgtgatcagcgtgcggacacagcatcagaactgcgattacacgccgcttgaggggatggctgtgcatggccgagcgaaagctgttttcctgcgcggcgagcaggtcgtgtcggacggggaagtgatccgcgcgcatcgcggcgcgtttgtcgcgcgcgggaggtccgatctgcaacggtgacatcgcggcaagcatctaaaaaaacaggcccgtgacagctttgctgtcacgggccttttctttcggaaagcgggggattgcaaaatccgcgccagccgcgcggcgtctgtcacgccttctgctgacggcaggccctgtgtctgaacaaggcgtcttacggcctgcgggccgcgcttttttgtagggctgcggcccagggtttgagggcgctgccctcgaaaacggccaagacccgcgatgggccttggccattttctcacccgccgccttttgaaaaaggcgggcgaaaacttttgtttgcgatgcgccaagccttctgttcgcggcgcagccgactaaagttttttggcccacctttttttcaaaaaaggtgggaagttttttgccgagcttttttcaaaaaagcgggcgaagggagtcggcgtcggcgcggtaatcgatatcgaccagctcgagacggtttttcgtctccacaatgcgcaaaagcggcatatgcgccgcgacgaccgcgccgcctgactggcctggcgcgagcgcgcccaactctgaaaacagcgcgcgcgggaacaggaccgggttgccgcgcttgccgcggtagccgagcgccacaatggcgccgggatgcgcaatgaattcatcgacaatcgcctggatactgcgcgcggtcaaaagcggctgatcgcagacggaaaaaaggcatccgtccagattcggcgcgagcgcgtcaaggccgagacggatcgtgcgggcgacgctatcgtccgcaccgtcgttttcaacaaccgtaaatccgcgctgcgccgccgtaacagcaacctcggcataacgcgttacgacaattgtctgattgaacagctcgcagggaaaattgccgagcaccgtttcaatcatcggccgcccgttgaattcagagagcagcttgttgccctgaaaccgcttcgattgcccggatgcgagaaaaatacatcccagtttgagagaagcgcccatatcgccacgacctccatcactgcggcccacgctgcgcgtaagccggtcatttcttctattatataggatgcgcgccgctttgcgcaaggcaaaacggcgcgccggagcttttatttttttcggctgtacggcgtctgttcgagcggcaggcgcgtgcggaatatgccgtcgcggttgtagtaggcgagctggacggcgggcggcgtcgggatcgaggcgatttctccgatccccttcgcgccgcaggccagctcggaatgcgccggaccttcgacaatgatcgattcgacgtcgggcgtgcggtcggccttaaagagtccgagcgtaccgaattttgcggtcggtcggccgtctgcaagcgggaagtcctctgtcagcgcatagccgaggctcatcacgacgccaccctcaatctgtccctctacgctgattggattgacagcctgccccacgtcgtgcgccgcgatcaccttgcaaatgcggccgtcgtcgtcgagatcaacgagatgggtggcgtaaccataagcgatatggctgactgggttgggcttgtcggaccccattttgtcggtcgcgccgaggtattcgccaaggaattcacggccgtttaaagccgagagcggtccgccgccgcgcgcttgggcgagacgcagggccgcgcgccgcgtcgcttcgccggtaaaaagcgtctgacgcgacgccgtcgtgttgccggaatcgggcgcgccggccgtgtcgggcgtctcgtagacgacctcgtccgctgaaaggcccgccgcctcgcaggcaatctgtgtgacaatcgtgccaagcccttgcccgatacaggcggcgcttgtacggatatgcacccgcccgtcctcaacggtcaggcggcagcgcccggcgtccgggatgcccacgccaaggccgctgtttttcatcgcgcaggcgacgcccgccttgggatgcgcgtcgtaatacggcttgaccgcctcaagcgtttcgacaagcgccgtcgtctcatcggcgatctgcccgttgggcaaaacctggccggggcggattgcgttgcggtaacggatttcccagggggtaatgccgaccatttcggccagcaggttcaggttgcattcggtcgcaaagcagctctgcgtcacaccgaagccccgaaacgccccgcacggcggattgttagtgtagtaagccttgccgtcgatctcgatatcctgatagttgtacggcccggccgcgtgcgtacatgcgcgctggagcaccggtccgccgagcgacgcgtacgcgccggtgtccgcaacgagcgtcgccttcatcgcggtgaggcggccgttttcatcgcaggccgtcgtaaactccatttcaaagccgtggcgctttggatggacaaggatgctttcggcgcgcgtgagggaaaccttgacaggccgctgtgtgagcacagcgagcacagcggcgtggtgctggacgctcatatcctccttgccgccgaaaccgccgccgaccatcttggcgacgacgcgcaccttttcaggcggcaggcccgtcgcctcggcgcattcgcgttttgtctgatagatcccctggtcggcgctgtagatcacgacgccgtcgccctcgggcatggcgaccgccgtctccggctccaaaaacgcatgctcggtcggcggcgtgctgtagcggcgtgtgacgacgtatttggagcggcggattttttcctccgcgttgccgcgtacaaggtgctcatgcgcgagcaggttgccgctttcatgcacctgcggcgcgccgtccgccatcgcctcggcggccgaaaggacgggcgtcagctcctcgtattcgaccgcgacgagcttttttgcctcctcaagcgcctctttcgtctcagccgcgacgagcgccacagcatctccgaggaaatgcgtgatcccgcctacagggatcagcacatcgtaatcctttttcagatggccgaccttctgcttgccgggcaggccggcggccgtgacgacggctgcgacgccggggagggcgcgcgccttcgacacgtcgattgaaaggacgcgcgcgcgcgggtacgcgctacgcacggcgctgccgtaaagcatgccagggatgcgcatatcgtcggcatattccgcgtcgccgagcactttggcgggcgcgtcgacgcgcggcatgttttctccgacgcgcggcccgggcgccgtctgcgggacaggcaggccctcgcgcagatatttggcggcgagcaaaacggcctccaggatttttttatagccggtgcaccggcagatattgtttttgagcgcctggcgcacctggtcgggcgtggggtcgggcacggcgtcgatgaggcccttggcgctgatgaccataccgggcgtgcagaaaccgcactgcactgcgccgcagcttgtgaaggcccaggcgtaaacgtcgcgctcgcggggggaaagcccctcgcaggtgacgatcgatttgccggcgcacttcgaggttttgagcacgcatgccttggtcgccttgccgtcgacaaggaccatgcatgtgccgcaggccccttccgagcagccgtttttcaccgaggtaagcccgagcgtttcacgcaggaaaacgatcagtttttcgtcccgttgggcgcgaaccgccgcgccgtttaccatcatttcaaacattgcacaagtcctccatcctgacaggccagtgagcggaaagccgcgttaaaatagtacgacttttataattatggtataagtttatcatctatatgttgggaaatcaagtggttaattgccaaaatcaaaaaaatatttagataaataaaatttttttaagaaaaggtattgacttcctttctttctgtgctatgatgggattacaggaaaaagtcataccaggatcgattttcacaggaggatggcttgtatggagcagatcaaatgggccgccaaccgcatgccgaaaagcggcgaccggcagcttggcgtgatgtcgcttgagaatgtcgccaaggcccgcaaattccaccgcagtttcccacagtattccgtcacgccgctcgcacggctcgacaacatggctgcgcagctcgggctgggcgggctgttcgtcaaggatgaatcgtaccgctttggactcaacgccttcaaggtgctcggcggctcgttcgcaatggcgcgctacatcgcgcagcagctcggacgcgatgtctccgagatgacctatgaatacctgacctcgcaaaagctgcgcgacgaattcggccaggcgaccttcttcaccgccaccgacggcaaccacggccgcggcgtcgcctgggcggccaaccgcctggggcagaaggccgtcgtacatatgcccaagggcagcacgaagccccgctttgacaacatcgccgccgagggcgcgaaggtcacgattgaaaaggtcaactacgacgactgcgtgcgcatggccgccgccgaagcggccgagacgccgcgcggcgtcgttgtgcaggacaccgcctgggagggctatgaggagatcccggcgtggatcatgcagggctatgggaccatggcttcggaagccgccgagcagctcaaagaggccggcgtcgaccggccgacgcacatctttgtacaggcaggcgtcggttcgctggccggagcggtgcagggctactttgcaaacctgttcccggactgcacgccgacgaccgtcatcatggaggcgcaggccgcggactgtctttacaagggcgcggtagcgtgcgacggggatctgcgcattgtcgacggcgaccttcgaacgatcatggccgggctggcctgcggagagccgaacaccatttcgtgggatatcttaaaaaatcacagcagctttttcgtctcctgccctgactgggtggcagccaaggggatgcgcatgctcgccgcgccgtgcaggggcgaccggcaggtcgtctccggcgaaagcggcgccgtcggcatggggcttgtcgccacgctgatggaaaacgacgactacagggaattgcgcgaggcgatcgggctcgataagaacagccgtgtgctgatgttctcaaccgagggcgacaccgacccggaaaactacaggcgtatcgtttgggacggggcgcatccgtccgcgcgctgaacgattggatcatgcaccgaatataaacaggcagtctgcaaggaggaaacgacaatggatttttcgaagatcaaagcggcggccgagggttaccgcgccgacatgacaaaatttttgcgcgagcttgtcgccatcccgggcgagagctgcggcgaggagggccacatccgccgcatcgaagccgagatgaaaaaggtcggctttgacaaggtcgtcatcgacccgatgggcaacgtcatgggctacatgggcgccggcaagacgctgatcggctacgacgcgcacatcgacaccgtgggcgtcggcaaccgcgacaactggacgttcgacccctacgagggctttgagacggacgaggagatcggcggacgcggcacgtccgaccagctcggcggcatcgtctcggccgtatacggcgcgaagatcatgaaggatctgggcctgctctccgacaagtacacggtgctcgtcaccggtacggtgcaggaggaggactgcgacggcctctgctggcagtacatcatcaatgaagataaggtgaaaccggaatttgtcgtcatcaccgagccgaccgacggcaacatctaccgcggccagcgcggcaggatggagatccgcgtcgacgtcaagggcgtttcgtgccacggctccgcgccggagcgcggcgacaacgccatctataagatggcggatatccttcaggatatccgcgagctgaacaatcacctgcattccgacccgttcctcggcaagggcacggtgacgacctccgagattttcttcacatcgccttcgcgctgcgcggtcgccgattcgtgcgccgtctcgctggaccgccgcctcaccgacggcgagacgtaccagtccgcgctggaggaggtgcgcaatctgccgtccgtcaagaagtacggcgccgaggtgtcgatgtacaaatatgcgcgcccgtcctggacagggctgagctatccgactgacgcgtacttcccgacctgggtcatcccggaggatcatccggcgaccaccgcgatggtcgaggcgtaccgcggcatgtacggcgaaccgaaggttgacaaatggacattctccacgaacggcgtttcgatcatgggccgctacggcatcccgtgcatcggctttggccccggcaaggaggcccaggcgcatgcccccaacgaaaaaacctggaaggaagacctggtgcgctgcgccgccgtctatgccgcgctgccgacaatgtattgtaaataaaacacaaatgcatcgattgcaaaatttaaggtttttggataatatgctttattttgaggcgtaaaaaccgacatgtttcataaattacatctaaatgtattgaaatagcaggccgattcgtgtatgctgtatttataatatggagtgcgtttaaaatcggcctgcaacacacagacgattgattgtgaaggggtaacaataatggatcagaaattgcaggcttatatcgataaactcaacaagctcaacttcaagggcatgtatgaaaacgacttctttctcacctgggagaaaacgaacgacgagttggaagccgtctttactgtcgccgacgcgctgcgctacatgcgcgagcagaacatctccaccaagatttttgagagcggccttggcatctcgctgttccgcgacaattcgacgcgcacgcgcttcagcttcgcctccgcctgcaacatgctcgggctggaggttcaggacctcgacgagggcaaatcgcaggtcgcgcacggcgagacggtccgcgagacggcgaacatgatctccttcatggccgatgttatcggtatccgcgatgatatgtacatcggcaagggcaacgcctatatgcatgaggtttcccagtcggtgcgcgagggttaccgcgacggcgtgctcgagcagatcccgacgcttgtcaaccttcagtgcgatatcgaccatccgacccagtgcatggccgatacgctgcacctgatccatgagttcggcggccttgagaacctcaagggcaaaaaggtcgcgatgacttgggcgtattctccatcgtacggcaagccgctgtccgtcccgcagggcgtcatcggtctgatgacccgtttcggcatggacgttgtgctggcgcatcccgaagggtatgaggtcatgcccgaggttgaggaggtcgccaaaaagaacgcggtcgcttccggcggcagcttccgccgcaccaattcgatggccgacgcgttcaaggacgccgatattgtctatcccaagagctgggcgccgttcgccgcgatggaaaagcgcacgaacctgtatggcgagggcgacgccgaaggcatcaaggcgcttgaaaaggagctgctcgcacagaatgccgagcataaggattggtgctgcaccgaggagcttatgaaaacgacaaaggacggcaaggcgctctatctgcactgcctgccggccgatatcaacgatgtctcctgcaaggacggcgaggttgaggcgtccgtgttcgaccgttaccgcacgccgctttacaaagaggcgagctacaagccgtatgtcatcgcagcaatgatgttcttagcgaaggtcagggacccgcagcaggtgctcaaggcgctcgaggagcgcaaaacggcgcgctggatcggttgattgccggtccctgcgccgcccctccgccagtcagataaacgccgctgtcgccagaggcgtgcaaaatatgaataaaggtggtacttatcatgggaaaaagaatcgttatcgccctcggcggaaacgctctcggcaacaatctcccggaacagatgattgccgtcaaacagacctccaaggcgattgcggatttgattcaggaggggcatgaggtcatcatttcccacgggaacggaccgcaggtcggcatgattcaaaaggcgatggccgcgctcacggcatccgattcaaaatacggcgcggttccgctgtccgtgtgcggcgcaatgagccagggatatattggttatgatctgcaaaacgcgctgcgcgaggagctgctcgaccgcggtatcagaaagcctgtttccacgattattacgcaggtgattgtcgacccgcgcgatcctgcgttcgagcatccgaccaaaccgatcggcaatttcctgtccgaggaggacgccaagcgcctcgtcaaagaaaagggatacacagttgtcgaggacgccggccgcggctggcggcgtgtggtcgcttcgccgaagccgcagcatatcgttgagattgaaacgatccgcgccctcatggacgctgggcaggttgttgtggccgccgggggcggcgggattcccgttatggagacggagggcaatcatctcaaaggcgccgccgcagtcatcgataaggacttttgcagcgcgtgcctggcggagcttgtcgatgcggactgcctgatcatcctgacagcggttgaaaaggtcgcgataaactttggaaagccgaatcaggaatggctgtccgagctgacgcctgaacgcgcccgcgtattgatcgccgaagggcatttcgcacccggttcgatgctgccaaaggtccaggcggccgtccagttctccgaatcaaaggccgaccgttatgcattgattacgctgcttgaaaaagcaaaagacggtattgagggaaagaccggaacgatcatccgttgatgcagtacacaacgtagtctttaaatccccgtccgcgaaaatgcacgggcggggatttttttacagcaggatgacaaaagccgccccgtatggggcggcttttgccgattgtggtaagtttatgggggtgctgattgtttatcagcttgatccatgcctatattatagcataggcaggtttaaaatagaaattataaatttctatatgtgaactgatttatagataaaatatattaattaacgattgtcaaggatcggtacgaacaagccgttttccgcccggacaagctgttcggaactgctgccgataaaagggattgggtcctcagcgcacgaaaagcgcgcgcatgttccacaggaggagctgagactgcgcggaacaggggaaagctgcgcgcggataccgtgcgcagccagagtccgcacgcttttgagtgcgtcgtaatgggtgaaaaacgttgcgatataatcggccaaatcctatccctccgcctgtattcagagcgtaagcgtcagacggtagtcgccgccttcggtcgctgccgttacatgataaccggcgtgttcagcaaaacgcgtgacattctctttcgcggttggattatccacgagcacctcgcaggatgccggggatccggccagcagatttttggtcataacgaccggctgcgggcaggaaagtccgcgcgcatcaatacagtcagccataaataaaacctcctcaattaagcggttatcttttgttttgtgtccgcggcaacggtttcgcgcgtattgagccacgcgattgcaaacatgacgataagcgccagaatggtgacagttttgcccgccagggtcggacctccggtaatcgcaccatcctccgcaacggctgtggcggcggaagcaaggccgaaattgtgggcgaatgccgcgccgacaaaaaatccggcaacagtcacagcggaatcggagtttccttcacctgccagaatcaactggcgcatcgggcagccgccgagcaggacagagccgagtcccacagcggacatggaaaggaaattccaaagtccatcgatatgcgcgacaggctggcccataaagccgaccttgaaatagccgccaaacaccgcgttcagaacggcattgctgacaagcgccgctgccaggatcgccgcgaagccggccagaagggtccagtccttaaagagaagaacgtcgcggatgccgccaaccatgcacagacgcgtgcgctgtgcaagcgcaccgacgatcagaccggccgcgagcgaaatccaaacaggcgcacgcatggagccgggaccgctttcgctgaacagtatgtaggcgggcgcggcacagagcagtgcgaaaaagacgacttggatcaccgacagccacgcgccgtcaattaccgggacggagtaggtgcgtttgaggctgtagccgcgccccagaaattggacgccggcaaagatgccaaccgcaaagccgacgattccgacgaccgcgttgagatcgccgccggcgatacgcaggatcatgcggaacggacatccgagaaagacaagcgccgtgatcatgacaaaaaatccaaggacaaaccgtgtcatcggcgaggagccgccgcgtggaaggaattcctttttgaccgccgcgatcacaaacgcgccaagaaccaatccaatgatttcaggccggatatattgcacggcggcggcctgatgcagtcccacagcgccggcggtatcacggataaaacaagcgatacaaaaccccatatttttgggatttccgagcagaacgagtacagcggcgatgattccaataatcagccccgctccaatcattttttgcttccctctcaaaacaaacaccactttcaacaaaaaagatcgtggaatcgcgaatcctttggtgttattatacttccagaggagagaaatgaaaaattgtttttttaaatacaagattgcttacatatagaaattttctatatatatagaattcgcggttgcagacatagtacaatagataaagaaagcatggacctgtgcggccccaaaatgaaaggcggtataatgatgcagcgcatctatcttgacaatgcggccacctcctatccaaagccaaaggaggtggcgcgcgccgtggcggactatattgacaacatcggctgcaatgtaaaccgcggcgggtatgcagcggcttattccgccgcccaggtcgttctggatacgcgagaacagctctgccggttgtttcatttcccggatccgcgcggcgttatttttacagccaatatcacagtttcgctcaatatgctgctcaagggcctgctgcgcccgggcgaccatgtgctcgtcagcgcgatggagcacaatgccgtcatgcgtccgcttgtgcagcttgcacagcaaggcgtatcgtttgaccgcattcctgccaaccgggacgggcagctgccggattcatcgctggaaagctgtctctcctcgctgctgcgcccacagacgcgcgcggtgatcatggcgcatgcctctaatgtttgcggtacgattctgccgatcgaacgcgtcggcgcgttttgccgcgcgcatgggctttttttcattgtggactgcgcgcagacaggcggcgtcgaatcaatcgatatggaagctatgcatatcgacgcgcttgcctttaccggccacaagggtttattgggcccgcagggaatcggcggttttttggcgcatgatgcgcttgccgcacagatggagccgcttctttcaggcgggacaggcagtttttccgacctcgaaaccgttccggagctgctgccggaccgcttcgaacccggaacgccgaacctgcccggaattttcggcctgcatgcagctttgcaatatctggaacagactggaatggatatgattcgcgagagggagcaggcgttgacacagcggtttatcaaacgtctgcatggtgataaacgtatccgtatcgtcgctgaaagtgcggcgcggcggatgtctgtcgtttccctcgattttatcggggctgataatgctgagattgcatttcgccttgattcagaatatggggtgatgacacgctgcggactgcactgcgcgccgaacgcgcataaggtgcttgggacattcccgcagggaacggtgcgcttttcttttggccattttaattctgaggaacaggtggattatacagcggatgctgttttaaacattttggcgtcggagggataggcgatggatgaacggcaaacgctgctgcgttccattccggctgcggacgtgctgctgcgcgcgccgtcgcttgaggcggcggcgcgcgcacacgggggcgcggcggtgctcggcgcggttcgcgccgagctggacgcgcttcgcgcgtccgtattgcacggcgaagcgcgcgcaattccgccgcgccccgacctgtgcgcagccgctttgcagcggctgcgcacaggccagacgatgcggctgcgtcatgtagtcaatgcgaccggcgttgcactgcatacaaatctgggccgtgcgccgctggcagacgcggcgtgtacggccgtgcaggaggcggcgtccaattatacaaatcttgaatatacgttggaaacaggcgcgcgcggcagccgtaccgctgcggtggaggagctgttgtgcgtcttatgcggttgtgaagcggcctttgttgtcaataacaatgccgccgcagtgctgcttgcgttggccgctctgtcgcgtggaaaaggcgcggcagtgtcgcgcggcgagcttgtagagatcggcgatgggttccgtctgcgcgatatcctggaggaaagcggagcgcgggtggtggaggtcggcgcaaccaaccgcacgcataccgacgattatgagcgggccgccagggaaaatgatcttgccgtcctattcaaagcgcatacaagcaatttccggatggttggttttacacagtccgtttcgcttcgtgaattggcacggatcggcgtgcgttatggcctggcgacagtggcggacctcggcggcggcgcgccgctggacgaggcggcgtatccgttttccggagaaccgtccatatcgagggcgctgcgcgacggcgcagatattgtctgcttcagcggcgacaaacttcttggcggaccgcaggccggcatcctgcttggacgcgcagaattgatcggacggatgcgtctgcatccactggcacgcgcgctgcgcatagacaagctgtcgctggcggcgcttgaggcgaccttgcgcctctattgcgacccggcgcgcgccggcaacgagataccggcgctaaggatgctttgtacagctcctgagacactgcgcgcgcgcgccgtctatttaaacaaattgattgaacaggaaggcgccaattgtgcaaccgagattatttctgtgaaacggccggtcggcggcggatgcgcgccttcagccctgcttgacgggttcgctgtcgcggttttgcctgcggcgctgcatgtggaaacgctggaggcgcgcctgcgcgcggccgcgccattgccggtcgtcgcgcggatctcgcagggacggctgcttttggatacggcgaccatccgcgacgacgaatgtccggctgtcgctgccgcggtgaaagctgggtgcgtgctatgaaaacggttctgattgtaacggccggccatgtcgaccatgggaaaacagccctgatccaatcgctgaccggcgtcaacacggatcgcctggaggaggagcagcggcgcggcatgacgatcgatctcggctttgcgccgctcgatctggatgatgatatacgggctgatttgattgatgttcccgggcatgcgcattatgtaaaaaatatgctcgcaggcgcgggagcggctgatttggtgttgatggttgtggccgcggacgaaggcgtcatgccgcagacacgcgagcatcttgcaattttgtcgctgttgggcgcacagcgcggcgtggttgcattgacaaaatgtgatctggctgacccggaaacgcgtatgcttgcacaggcggatgccgttgaggcgtttgcaggcagctttttggagcgtgctccgatgatatttgtttcatctgtcacgggtgaagggcttgatgacctgcgcgcgctgttggcacgaaaagcgagggaagttgaattccgccgtgcggaccgcccgttttttatgccccttgaccgcgtgtttacggtcaaggggtttgggaccgttgttacgggaacggtattggatggccatgctgctccgggggatttattgacgcttcagccgtccggagaggcggtgcgtgcgcgcagtatgcagagctttggcaaggctgtggagtatgtctctgccggacagcgcgcggcaatcaatttaccggggataccggccaagcaaattgaacgtggctttgtactgactgcgtccgcatattgccgtgcagggatgctgctggatgtacggctttatacgctcccatcgcagccgcgtgtaattacacacaatacacggttgcatctgtctgttggaacggcgtgcgttgtctgccgggtgtcgctgccgggcggcggcacaatccggccgggagaaagcgcgtatgcgcgtatgcgcctggaaacgcctgtagccgcgcgttttggcgaccgttttgtcgtgcggttttattctccggttgaaactgtgggcggcggcgtcgtccttgatagtgcgcctcgctttggaaaactaagcgctgccgggttggcgcgcctgcaaattcgggaaaacggcagtctggcagactgtatagccgatgaagcgtcgcgcgcgctgttgacagaacaagacctgcacgcgctgttttgggaacagtcggaaaatcaatggcaagctgcccgtaatgaactgttcgctgcaaaacgtattctgaagctggggtcttacatgctttcacagacgctgtatggatcacgtctgcatgctttgatactggcggttgaggaatggcatacggcacatccgcttgacgaaggaataccgctgccaatgctgcgcgagcgattcccagaggcgttgattgatgcggctatacggtcgggcgcgctcacgcgccaggggaacacggcggctctgccggggttttctccttacaagacgccgctttatatggagctttccgcgcggctgacagatatctatgaggcggccggctgcacgccgccggaggatacggctgccttggaatccgcagggattcctacggctgtccgggcgcgcctgcttgacctgctgtgcaagcgcggcgcgctggtgcgcgccgcgcccgcgctttgcttttcacaaagcgcgtatatggccgcgcgcgctattgcgcgcgcggccgggcccgccgggatcacgcttgctggtctgcgcgatgcgctcggcatctcccgaaaatatgcgcaggcgctgctggagcatttcgacgcggcggggctgaccgtccgggacggcgatacgcacatccccaaaggagatatataaaacgatagatgggcgcggatggacgccggtgtgtctcccggtcttcaaaaccggtgtgaatggcgcagaaccgtttgggtgggttcgactcccacacgcgctcgccaagcagcgcgcgccgggttttacccggcgcgcgctgtatacaataaagtaagcgcggcgcgatgtgaaggaaaggaaaccatgcacagccggcaaatacaggtgtttattcaggtcgcagacagcggcagctttgctagtgcggcagaaaaggcgccgagtcatgacgaataaacgagaagccggacgactattcatcgtctggcttctcgttgtcccattgcatttgattgtcaatgacagaattaacaaagccattgagactttcaccttgatttaaggacttgaaggagaacggctggggtggtataatgcaggaaaggaggtggctttgatggatgacagagtattgcttgaagcaattggtaagatgatggatgaaaagctggcaatcaacaatgaacagctccggcaagagatgaaggccagcaatgaacagctccggcaagagatgaaggccagcaatgaacagctccggcaagagatgaaggccagcaatgaacagctccggcaagagatgaaggccagcaatgaacagctccggcaagagatgaaggccagcaatgaacagctccggcaagagatgaaggccagcagtgaacagctccggcaagaaattatgcttgatttcaacacagtcattgaggataaagtctctaaggaaatcaggctgattgcagaacagcacagcgacatcgtcgcaagacttccatacgttgaggaacaggctgagataaaaagccgggtcagagttttggaacgtgttgtgagcaatctcggagcggaaatagacaaattgaaaaaagctgaataactgccaactggtgcgcgcggaacattttccgggcgtactttttatatcttaaaatccttatagggataattcttattgccaaccttgaccgcggccgctttgcgagggtatttggcgaagaaagtgtccaatgtgtccagagtctcgtctccgccatccataatctgatagcaaatcttccggaatttcttgggcagtttgacaacttccatattgacgccccccttaaaggtaggtaagcagctgctttggatcccggagggcacgaagaccgccttctgcaagagcctgcatttcattttcccctgcgtaggtcagcacaggagccagcgtgtccacccttttttttatcagcgcggtgaaacgggtgctgtgggcgatgccgcctgtcagtacaatggcgttggcgcgtccatccagcacgacaaacatggcgccgatgtccttgcaaatttgatacgccattgcgtcggttacaagggcggcaaactcatctccctgctttatcattgtttccacctcacgcatatcgtttgtgccgaggtaggactgcacgccgcccttctgggagatgaattcccgcatctgctcataagtatattcccctgaaaaacacatgtcgataatcgggccgactggcagtgagccgctgcggtccggagtgaaaggcccatcgccgcccatggcgtcgttcacatcgatgacacggccgtaacggtgggcggacacggtgattccaccgcccatatgcacggcaataaatcgcccgtcctcgtaggcaataccaagacttgccgccgccttcctcaccactgattttgtattcagggcatgaaacacgcttctccgttcaattcccgcaagaccggacagcttggcacacggctccatctcgtccaccaccaccgggtctaccacaaaggcaggaacattccagcagtggccaagatcgtctgcaatcagtgcgcccagcacggccgcatgttccttggcatgcgggcgcataagatccgctatcatcgcgctgttaatggcataggtgcccgattcaatgggcttaacaagaccgcagcggcccaccactgcatgaatactgcccggctccacaccattttccttcaaagcccgtgcgatatgtccggagcgcatatccttttgtccgataatactgccgcaggcatgcagttcatccgatgaatggcagattgtctcctcaaatcggcattcctcattgtcaaacacagcgatctttgtggaggtggaaccggggttgatggctaaaatacgtaatatgcggtcaatcattgctcatcctcctgttctgcgccgctgatttcaaaaataaagttccactcgcgcaagcgttgttcaaaccgctgcgcctcactttttgtaaaagcgattgtcaggctcatgctgctctgctctgaggctgcgataggggtcacgtgaacctgctccacattccagccattgcggcggatgtaagcggtgattcggctgagtacacctgcgcgatccttcactaccatggtgtaagtttttttcacactatccctccattattaaataaagccttcggtcacaggtgatggccatgaaccaagttcatccaagctctgaactctttttacttttgaatatgacggatatgctttcccatgtcattttaacaattaatcagtttttatctttgttattccaatggtatcactttctgtaaagggagaacacaataagagcgattatgatgcaccgcggatcggcaatgaatgaggaccacgcaatcccgtttacatctaccagccagtttaacaggaacatggcctgaatgtcaaacccgccttttcgcagcagcgacaggatacgctgctaggagtgatcatccagagcatatattccgtgcagcatcataacagacgtatccgtcctgagaatcggaaaaatcacaggacacaggacaaaaatcagcaggttataaatcaaagcaagtgcgccagcggcccaaagctgaagaccatgctttttttgctctgctcatacccaacgcccaagccgcaggaaaaaaggttggagccgccaattccaacagattcgccatggcgggtaacaggataaacagtgggattgtcgatattgccgctgccaagtgtcgggacgcatgggaaaaccctgcgggcagctttggcgtctatggaaccgctggatggcaaatgcttcaatagaataaagaaccgtatatatcagaattttgatatatgcggctcctgtccgcccaattcaggccgcgctgtaaattttaacatcaggatcggcgctccagagaggttttattccggcgaaaacatcgctctggaacatatctttggagagatacgcctgcgcgtattctacattgtcaagcctacgaaggacctggacatccttgtcacggatcaacagctccttggtcagggcgccagaaagcttctcgaggaacggaacgttatatcatgatggaaaatggataatgtttgagctaacggacacagcttcgttgaatgatttcattagattgctgaaaatcaaaagaaggccaaacaaaaagtaaggatactatcgaatcagctttagctgttatatgatacaaagtgggtgaaaaagatttcagagaagttggacttattgactatagtccagcccgggaggcgttggccaccaaccgaccactcaccagccctttctctatacactgccgtaccacttcttcaaatagccgtcgaaatatattccggaaggacagttttcgccgtcgcagttggctgatggtgctgtgatccagaacccgctcaaacagatccagcctcagataccaccgtagtgccacgtcggtctgaatccgctgctcgatctgccgctctgagggaatgccgtacagaaatcccaccagcaagtattttaccagcactaccgggtcgattggcggccgtccatactgatggctgtacaggtgcgcggtttcttcatatacaaagcccagatccaacacctcgtccaacttctttccaacctgctgcggggtcgatgtgcacaagtcatttctggcagctaccatcattaaaaccccggaaaacagcatgtagcccagttatcagaaaaaatgctattccacattcaactcagatctgaaccgcttcgccgactggctccatgggaatcactacctggatgtctgcatggaatccaccggaaagtaccgggtttctatcttcaacattttggaaaatggggtatctgtgttgtcatcgctaatcccaaatgggtcaaggctgtaaaaggcaacaaagacgataccaaggattccaaatggattggggatctctttcgtattggcttggtgaaaagcagttttattccagacaaggagattcgcattctccacgagttgactcactctgatgtctttgcttatacagatgctttttataacacattccgtccgcattctgcgcctggttggctctctcccgcacaatttggaactgcgcttacaccgtctcatgcagcctgatcgagcatctttacatatctctgtgtccatttaagttcccccctttttcttgtccgctgttccgggaagggttcagtgccggcctccatctgtcccaaaagcgtaagcgtgagcttctgctcgttacatagagcttgtttgtgatctcggatcccatttttcatttttactttacagcggccaattgccgcttctcaacctatggggataaagatctctaccgcagcggtcagggcgatgtagactaccggatgcctgttgaactttaccagtaggtagtagatggcgacgaagagaagaatggctgggaggttaaagaagtcggccacctgagagatggggacggtcttatcgatgagggtgaggctgatgatgtcccaggcggcgcaaccaataagggcggccaccgccgggcgcaggccgtagaaagcgccttggaccagaggactttcctggaatttccggagcatcttggcgatggtgatgacaatgaaaaaggcgggaatagtggtggagatgctggcgataagggcacctgagataccggcggcgttgtagccggcgaaagtggccatattgatgccgataggaccgggggtggactgggaaatagcaatcatatcaatgacttcggtgcgggtgaaccagttgaaattttcagcgatatcgtagaggaggggcagggccgccagacctccacccacggtgaaaaggcctaccttgcagaattcgatgaaaagctggaaatagatcattccgcctcgccgcccttcttagtggagaaccggcggaggagaattcccacaaccgcagagaagacaatcaccggaatgggagagatcggggtaaacaggagaagggccagcaccatcagaaaaataaccccggtggccttgtccacgacccctttcttccagagtcccaccgctgcatggagtaccagggcgcagacggcgattcggataccggtgaaggcgttttgcaccacggcgatatccatgatgttctgcaggaacatggcgatgattataattatcaccaccgagggagcgatgacccctgccgccgcggcgatggccccggccagtcccagcactttgtacccaataaagatggaggtgttcaccgcgataatcccgggggtacactggccgatagcataataatccataatctcctgctcagtagcccaatgctttccttcgatgacttccttttggaggaggggcatcatggcgtagccgccgccgaaggtaagcccccccaccttggcaaaaacgagaaacagttcccacaaagtcttcataatatactccgttcagccgcaagcccccgcccaagcagcaaggccgggtggggatagggcgtttttaaaatatgggatatgggaggccgggaaagggcggtggagcgtccttttgagcccttcccgaaaaatagacagtaaaaagctttaaaaaacagatatggtttggaaagtatgccgacagattttttagtacgtcgatgactggatgcatattaaaaagtaggacaagtgtagtaaaataggagacaaagaaaaaaggaaggaagaaaagaaatgacaaacgcaaaagcaacgccaaaatacagcgaagatttcaaaaaaacaatcgtaagcctgtaccaatcgggaaaaacctactttgaaatccaaaaagagtacggggtttcttcgtcagacctctccaaatgggtctacaaatactcccaggttcaggtggatgacgataccgttcttaccacgcagcagatcaaagcccttcagcgccgcaatgctcaactagacgaggagaatctcatcctaaaaaaagccattgcaatcttcacgccacactcagacaacgattagaagttgtccaggcactttccaggcagcacaatatctctccatcctttgctgggtactcaatgttcactgcagcgcctattatcggtatgtaaaccggcagccctctgccagagagcaggagaatcagcacatccggcaaaagattctggagatctatgccaaaactggtcagcgcctgggatgccgcaaaatcgggttttgtcttgcgcgtgatttttgcacatccatcagtgaaggtcgggtgtaccagctgatgaaagaaatgaatctctctaaaatgtccactgtcaagccccccagacctcccaaacaatccgatgattctcaggctttccagaatctgctcgcccaaaaattcgatcagccggccccaatctggtctgggtctgcgactttatctatgttcgggttggccaaaggttctgttatctctgcgttattctggacctctttgctaggagggtcattgcttaccgggttggcgcccggctggaccgcttcctcgccctggagactctccgggacgctgtccgcaacagaggcgtttctcagggcgtcatgttccattccgacaggggcgctcaatttacttctgccgatttccgaaaagtattggattcccttcacatggtccaatctttttcaaaaaaggggcatccctatgacaatgccgttatggagtgttttttcaaatacctgaaaaaacaggaactggaccgtcggcatttccaatctctcgatcaattaaagcacaacctacttacctacattgacggcttctacaaccccgtccgccctcattctcacaatcacggtctttctcccattcaagctgaaaataacttttttcggctgacatcccttttttacgttttgtttccatttcctttttactactttcctttccgttatatcgaatcattttgtgtccatcaattcgggaaagggggcgctctccccgtctgacgcgccaagggggggagaatgacgctgggagatgtaaaggcccggcgcaggggatcagcccggatggcccagatcgcaatccaccacctggctgaagccggggcgagaaaggaccgttttccagggacagatcatctggttgatggactggagctggccgtaggaatcaggtagccgccagtctccatcctccaaagagaagatggtgaggtccccaaaatacccaggaacaatggcccccagcagaggcagacggtagatggcggcggggacggcggtaaccttggtcaccgcatcctccaggggcatccccagggccataagcttgctcataaccaccgccagggaccagaccggcccgttcatgttggcattgtagatatcggtgctgatgctgtcggggataaatccttgggcaaaggctctttggtacactggccaggagaagctctccctgccatggcccacatcgatatagacgccgcgggtccgggcggccaggaaggcctccttgggggcgccgtccgcctcatagggggagatatccttgccatggtagctgtgggtcaccacgtcccctttccgcagcagggagacaatctgattggggtccgggggaaaacggccgatgtggaccatcagcggcaaattcagggcttctccgatctccaccgcgcgtttcaccaggtcgtagctttgggtgccggcaagggaaccgctgcaaagacatttaagcccttttaccagttcggggtgagcttccctggccgcccggaagtattccagacggatgctgtccaagtccagaatcttatggtgcgggaagtcgccccgggtgacatgacagttcagcatggtgtaatgccgggtcttttcctgagttacctgggcagcgaagtcctcgatgtccagtgcggcagtagttcccgcctcaacaacggtggttactccccgccggcagcccaaatcgtctgcatcaggggcgccgtcggcgattctccgggtttctccccgggtgtggacgtgaatgtctatcatgccaggggatatgtacatcccggtggcgtccagcaccgtggcgtcctccgccgggagatcgggcccgatctcccggatcaggccatcatccagcaagacgtccaatttggtacggaaataaccttgagcggggtcaatgagagcgccgcccttcaccaaaagtttgttcatggcattttcctttcttcccggctacggggttagaggaggctcttgatctcagcgtaagccttggcggccagctcggaccgtgtgagcttggtttccttgtcgatgatggaggtatagatgtgggggattacccgctcgcagccggcgtccagacagatcttcactacttcccggacattgtcgggggagagaccgccggtgggttccatgacgggaatgccggccttgacggcggcggcggccaccgacttcaactcctccaggtgggcggtaccgtggatgtcatagaacttgatggaggagagccccacgtccttcatcatggccatggccacgtccacatccaccaccaggtcggaaccatggcaactgacggggccggtggagatcttcacctttcccgggatgccagtggggctcatgaggcagttcaccagggtgtatttgcagccggcggcgtccagagcgccctggcagtacatggcaccggtgtagacctcgttggcgtgaccggggtcggtctgggcagccacctcggcaaccatcttccactgtttggggtcgccagcgcccaggcccacggaaacgttggtgagctttgccatgtaggcctttacatcagctacgcaggactcaacggtggagtagttcttggtaagaatccccaccagaacatggccgtccagggcctcggtcacttccacagcgttgtccagatcccgggccagcaggttgatcatcactttgtttttatagaaatccagtctttccagggtcataaaaaatcctccgttttctgccgcccccgccggcggttttttataaaaaccttccgcaccgggggcaacggaagggggaaagggtctagccttccaaaatcttcttcattttttcggcaatggcttccacgtcgccgggaaggatgggccggggatcaaagaagatggtgcccacattggcaaagtgatcccgggtatagatggcgggatcaccgtccttcagggcggccacgatctccagagcggtgagggggcagcttgactccacatccacgcggcaccggctgatgttccggcctgcctcgtcccaagacttacccacttggatgtggggcagcccggtgagggcatggatcatctgatccaccgtggcgttgagttgggcttcatgggctgccatatcccgtccggtgtaaatctccaccgccttcagcaggcccatcatgctctccttgccaatcttcatggaacggccgatgcccttatagtggagcttggccgcatcggtgaggtctttccggccgcagataaagccggaggtggggccttcaatagccttggcgccactgtaacagaccagatccgcccccatggcgatgtatttcttcaggtcctcctcggcagaggcgtcgacaatcaggggcaaatcgtggccgtgggcgatcttgatcatgtccgccaaggagaccatccctttctggacacaatggtgggatttgacatacatcagggcggcggttttgtcgttgatggcgccgatgatgttggctttgtccaccttgttggcgcagcccacctccacggggatagcgcctacggtgcggatcatctgggtaacaggggcgccgtaattgacgcaatgccctttctggatgatcacctggttcttcaggccggtggtgtcggggatcttctccaccagatccaggttggaaccggtcattactgcggcgatggaaaggcagatggccgcagaggtgttggctgtgacacaggtgccatcggctccggtgaaggggcagagaagctcgcccacccggtcgatgagttcgtcgatgaccacgtaattctgagcggcttccaccatggttttgccggtttcgtcatgaatggtagaaactccaagggcggtcatccggccgctggcattaataacccggcgcaggccggctttttgataaattatttccataatagcctcctggtttgttgaattcgctacatattatagcgtatgtttggcgaaaatggaaaatagtgtattcgccggaacaaccgcagcagtatagagggcaaagctcatcccgccccctatactgctgtgagaaagagctttttatgcggggatggggaataggaaagccaggaacatagcgcccaggatggcgccgccaacgatggccttatccatcttgaagaagatagcggcaccgatgatggagccgatgccagcggggatgctgtagctaatagcagacaggatgatcagaggcccaaggtagcggccggtggcattgccggcgcccatcatgatgttggtaccggaagcagccattccctgaggcatggtcttacggacagcgatgatgacgataccgattaccagaccgatgacagcaccgctcagaagggacaggacgaagttggtcaccagcatgtcaaggcccatggacatgaacagagcggtgaaaccggtgccgacaccggtcatgaaggagccgccgatatccataataccaaccagagggccttccatgacacgagccagcaggaatccagcggcataacccacaggggcggcccagtcgccggtagccataccttgtttaatcatttcagcgtgagcgatttcattgaaggaaccgaaaccgtgagtaataagcatgtgaccaccgccgatcatggtggcgcccagcagagcagtaagaatggggaaagtccagtcgctcaaaagagccttacgcagtttatccatagttcaatctcctctctccgattaacccaggaaattcgagaacgcggcgatgaggttgccccaaaaaccgcggccgataccgataacgatgaacagggcggtgataacagccagcatgattttgacggttttgttgtaaccgttgtctttcacagactgaccgatgatgatacccaggacgcagccaggaacggcgttacccatgatgaggtagccgagaccgcccaggatagtgccccagataccagtggtcttaccggcatccagcgcggcaagccagaagataatgggcatcacagtgttgatcatcaggttggcggcgggggccaggataccgctggcaatgatagagagggattcggggatggcgttggcgattaggttcagcagagccacggtgatagcaccgattaccgcgcccacgacgcccatcttggcaggatcctgaagggtttcttccacatttttgtttttcacaaggagaaagctggcagcccagttgggaacgatacggtgcagaacatcctgagttaaagcaccggcgccgatgacggcgcctgcagcattgaagaagaagcccagaccgaatgaaaagtgggcaacagggtcgcctttgcaggcgttgagttcgcccagggtccggaaggcacccatggcctggaccttaggggcatggaacattctggcggcacccgcggaaaccgcagcaccgcccaatgcgccgataatcagggacttgatgagaacctcaaagaacatagtacctctcctctcgcgatatttgctgccgggtggatcccggtgagcaagcggtcgaaagccgtcaaatgtaacggatggtgacgatgaccttcagtttgatgtaatagtcttggattcccttgggagcaaaaaaagccaggaatttttgcactttgtttttttcatcttcggcaagaaggataacatcgtcaggctccatatggatcagcaggccgtttacagagttgtaggcctcttttttcagcttggcgaaaacggcagcgacggcatcctcccgttttttcccataagcatccaggacaaattccttggtgattgttttcaagcaggattttcccagctgatccatctttatgcctcctctttcttccaattactcctgatcgggctggccgtggatctcgtagtaggcctccacaatgcgcttgcccagttcctcgatgtccatgaagccgaagcccagcacctggatgccatcctgcaccgcagtaacgccctcatccaccgaacgcatggagtggcggcacttatagccgtacttgttggaggccatcagggcgccagcgccaccgctgccgcagaagctcagccccaagtcggcgtttttctcgtgcatgacgtcgcccagtttcatgtcggcggccataccggggatgacataggcctcgccgccggctttttggatgccgtcggcaacatggttgcccttgcccatccgctcaccgatcacaataacaactttttttcccattttcgatacaccccttctctttgttgttggctgctgttttgtgcttattgccgctggtgcttctacgcctttttcatcttcatcatggccgcctggacatggatggtcaccaaagccagctcggagtggtccaaggtgattccataggccttctcaatgggttccagtacctttctggaggcgttcagagcgtccttctccagttgggagaggacatcctcccccaggtcatttaccttctcaccgctttccagccgcttcaccagattgatggcgtgggagatgaagccgatgccgccgttttcgtcaaaggcgaccccttcccgttccaggtcttccagtagggctgggacgtgtttttccactgaggcggagagttccggagtcagttccatcttctcctccacatttttcactcggtccaatgttgtcatattattccccctcagtttctatagcaatcagaatttcagcatctccacgacgccgccgacaatggcgcagtcggggcgaatggaggtgtgcccgatgagatcgttgccgtcggcatcgtggtattcgtagttgccttcttccatgtggaagacagtgatgtcggcggtgtatccttccttcagctttccgagacccttcatggagaagatggcggcgggagcggcggtaaccttctccacacagtcctccagagagatgcccagggccaacatcttgtccatggtcaggggcaggctgaaaacaggaccattgatatttttaatatgaaggtcggtgctgacgatatcagggataacgcccagggagaaggcggccctggcggtattaaaattgaagctggcgacgccgtggcccacgtcgaagaaaacgccccgatcccgggcagcctggacctcgggcttgatcttgccgttttccagcaggccgttgatcttgccatggaaagagtgggtgatcatgtcgcccttctccatcaccgccagaatctcctcaatatagggaagcggattcccaatgtgaatgtaaaggggcagtccgcaccgcaccgcaagtttcttggcctccttgatggggccgatgcccagcttgcccacggtgctgttgctggcacgggctttgatggctacaatgtagtccttgtgcttgcgataagcttcctccgccaaatccagatcccacttggaggggtcgtcggcctcgggtttgataaagagtcccttccgggagaagtgcatctcggagaagatccgggtcttggagggtttgatgtagttctcgatgaactcctcaatgttctctgggccggcggtaccggcgtcgcagatggtggtgaccccgaaggggacgccgatgctgtcgggttccacccccagatggcttccggggaagacatgggtatggatatcgataaagcccggggaaacgattcgcccgcccaggttcatcaccttcatatctggctccacccggatctggccggcgattttttcgatttttccgccgctaaggaggatgtccttttcagccatcagaaggccttcgcttttgtccagtagtttaccgccggtgagaagaatacgatccataagataaaaccttcctttccctatgatcatatgaaatagcgcataagcgccaaggcttccttgtcagggatgtgcaggccatattccgtggaaatctcccggagttgccgcacaaggtactcataaacatagatgttctcatttttgtactgttcgctggcgtattcccggtcggaaatccctttgcgccagcggggaaaagacatgaggatgtggataatcatgccgaacagcttgtcgttggaaagctgaatcccgcagtcccgccccagttccatcagggcgctgctgatccgggccagggtcatggagcattggaacatgatgttttcctcggtcatctcccccagaggctggatagcttcggagtcggtgaagggggcgatgctttccagctcccggaggaaacactcccgctccttggggcgaacgtaccggtctgccagttctgcaaaggagtattggaaggattcctgcccggcgtcgttctcatggatcctgggggtgctgaggcggccgttgaggtagcggttgatccggtcgatctcggcggcgctgatgatggggctcacctggaataccggtttatccagaggcggcattttcacagtgctgataatgaaatccacttcggccaggacatccgtgttcccgacgtctagagccgaaagggtcccttggatctccagacgggggatattgttgcgaatccggttctggagcacgatggcggcaccttgtccggtattgcagacgataagagcctttttgctccgtagccggttgcattcctccacgttggcggcgatgtggatggcgataaagccgatctcatcctcgtccagggggatgccggtacccatctcaaacacctgggacatctggtgcgccaccgcaaaaatttcagggtagtttaccttcatctgggccagtagcgggttgggggagggtatctggagctggtatttcttgaccgtgagcttcagatggttcataagattcatcttcaacttgtctcggtagaaatccggcatgtcgtagctgggataggaatggagaacctccaacatcttatctacaatggaagaaagacgttccgccagtttatcgttggtttttgggggaaacctgatattgcaggagatgagccatttggaaaggtgtgccgcttctctgctccccagatccaaatggaacctggttttaagcctgtcaatgagaagggaagccagttgttcctcccgaggttctccctggttcccggaaggcttctctcctgagaaacagttcccaccgcaggctcgccggactaagactgcaagatagaggagaaggcggatatagccgtcctctggcatggtgtggtaggtgatctcccttgcgtagtccagaagccccgccagagcgtctaggtctaccgccgccagataatccagagccagggatcggagtgtgtgctcctcccggcagactccccggaccacacggttggtgagactgtatcgggtgatggcgtggctgtcgtcggtaagctggatcaaggcctccaccagacaggcacggaactcctcttcacagccacgcaggcggtagccctccccctttttgctggcgatactcaattgtcttacccgtaactcctcccgcaggctatggagatcgttggtgacggtgggggtgctgacccgaagaaaggacgccaggtcctccgctttaatggcggtttcagaaaacagcatatggtagtaaatggactcccggcgctcctccggggaaagaatctttaccaccgcgccctctccgtaaaaagaggagagttttcggcggacatcctcgccaccccggatcattactccggcatggggacgctttaccagctcgccgccttggctcttgagccagatgcttaccacttccaggtcgtagcggatggtgcgttcgctgaggctgaaccgcttggcgatctcccgtactggtacacaggcggtcatgccgctgaggtatcccaaaagtgcctgctgtcttctggtaagctggatcatggaaacagctcctcgtttcatttttgagaggaaggcgcaggcccctcccttatttaaaatgataatcgataaataggagagacacaacacaagaattcttcacccctaatgttgcaaaactttacattccttaaagaaagagttcggggttttgtaaagagatggaaaatatttagacggtttaaccaagaacaaaaagcattcctgataaaaaatgacgggcgcattgcaatatttcaatgcgcttttcaaaaaagccaatcagatgatactttttatactaaaattttcacaaagcattgtctgtgttgtacaagagcgggattttccccagacgcaagggcaaaaaacagggggacttccttattttacccatgggaagaaagattatcgctgcaatgggcaggtcggatcttccccgaggaaaggtatcgggaaaaagaaaaccaaacagtcacgccccaaaaaaagggggacatgaccggattctgtaagggcttatgccagaactccacgaggtttttgactacaccaccccaaaggatgcttgggcatactacagacggatcctctattgactttgggacaaagtcgaagtggagaaagttcaaagggcggtacctgcggggtgccgtcttttgatatttccccacgggacaagtgggaaaggctggcatatacacgcactttcgcaaaggaggttttcaatgacgcaagctgtcacttatgcttaattctcgcttaatccccgtgcctcctcaaattgagcaacaacgaatttctgttaaggccagagaactagtcagtttgatttctaatatcgaaaacgataaagaaagcgttgttggaatagtagccaacgcaaaatccaaaattctcgaccttgctatccgcggacagttcgtcccgcaggacccggctgacgagcctgcctatgttcttctggaacgcatcagagcagagaaagaaggaccttattcgccaaggcaaaatcaagcgtgataagaaggaatccgtcatcttccgtggtgaggataactcttattatgagaagattggaaataaggttgaaaatatcgacgaccagataccttttgagctaccagttggctgggtctggtgcagaggtcattcctgcttcgagagcatggagagcacaaaatcgcaaagtgagttctttaattacatcgatattgatgccattgataatcggctccatcgaatcaaggccgcaaagcatctcctggtatccgaggctccaagccgagcgagtcgagcagtaaagaacggaagcgttctgttctcattggtcagaccgtatcttgagaatattgcactcgtagaggaaagatatagtcactgtattgcatcaactagtttctatgtttgcaattccaacggcgcattgttacccgaattcatgtatttcctgatgatatcaggttatgtggtcaacagtctaaatcagtatatgaaaggagataattctccgtctataagcaaagacaacatcgaaagttggctctacccaataccaccgctggatgagcagaaagtcatatgtaccaagttgaatacaacgtttactctgattgagaatgtaggaaagagcctcagctgagtctcttttccatttggttgagttcgaacagcgtcgcgtcaatcatttcagttattttgcgttgttcagatgctggtgggagtgggacaacagctcgttttagcatatcttgtgtaagctgattgatagcggtggagttgctatcatcgaacacacttctaaagaagcttgaacgaaggtgttgcacgatatactcaaaatactctgtcctatatatcgccataaatgcgccaaatgatgcagcctctcccaaatttgaaattagcgcacatttaccaacaagaactctactcccgtttcgggcgcaaatcaagatatcattcttctgtgcgtattgattttttctgatggtggttttaacacgaaccaagtcgcttaagtcaattgggtcattgacaatgttgcacgaacgcaatactataaccccatccggttctatatcggttggacgatatgtgaggccaagatttgttgttccgatcatagaaaaattgcaccactcccaaccatcaggaagctcaaaaggaagctgatcatcaaggcaatgtaacttttcatcagccatcttctcataataagagttatcctcaccacggaggatgacggatttcttcttatcgcgcttgattttgccttggcgaataaggtcttctgtctctgtctggattaccgggagatctccctctacacctatctgctccggtgcgagaaccgtgaaacctaccagtgctaccccagctacaagaccattggcaaagcaatagtaacgcatcatcccacgctccgcttcctccggtagccgttctctttggatcgccgccaggatgctgtccgcgtattttaccgcctcggaagcgcccagttccataggggaatcctcccagtcacccattggtttttttcatagaggtccacggtcatgggtatatacagcttgagcagggccggcttatgtggcaggacggtaaaactgtcctctccaatcaccagccccagtgtgcgtccattgtcccaccggcagtggaaggttcccacatcgtcaatggcctgcaatgtgcccagcgtccccagcgctaccgggtggtatgggtctttcatctctctgagtcgaacgcggctgccaatgggaaactgctcctgtagaaatttcagccattcctttggaatattcatctcatgccccccaattcaattttctcatcctggtcatcctcgttctccccaaaatcatcttcgccgtccaggtcaaagggcggatccgcgaatagaatcgtatcggcctccagatcttccttcaggttgtgcagcccattttcagcttcccctatgggaaaatacatccatttcccctccagatcaaagatatagctgtattccacgccatcggtttcccaatcgtccagctcatccagggacattatgcgggcgccgcaatctgtcaaatcttcgtccctttggtatgcgatggtcacctcaggctgcgcgtgattggaattatggggatattgcgggtcaggctccatcctcttggagtgatataataaaaccgcacacctaagggaagaaaggacgagaggaaatgggacaaaaatacagtgcggaatacaaggcagatgtgctgaagctggcggatgagatcggggtcagagcagcctgtgaacatctgggtctatcaacaaaaaccgtgtataactggcgtcgggaagagcggctgaagcacggcgaattacgcggcgtgcagccgggcgaaacagcggagcaggcggtcgagcgcctgcttcgtgagaacaaagaactgcacgaggcaaattacatactccgtaaagcgctgggttttatggcgggtcgataaccggtgtacgtccgcgggaactgtatgcatggatcaatgagcaccatgacggaatcagcatcgccctgagttgtcaggcgcttggcgtgcggcgggaagggtattacgaatggaagcatcggtccatgcggacagacctcgatgcacagctgatatcggccctgagaaaagcgaggaaggaacacccgtgttatggcgtgcgcgggctgcgggagactgtggagcctacgcttcgcgtgagctacggcaaatgttatcgtctctgtaaagaaaacgggctgttacaacgccaaaaacatccacatggcctgacaaagtgcaatcatcgtgacccacagagtgacgatttggtgcagcgggattttaccgccaggaagccagacgtcaaatatttaagcgatatcacgcagatcgaatgtgcggacggcaggctgtacctggccgctgtgatggactgttatgatggggcggtcgtcggcttctccatgaagcatcatatgcgtgccagcctgtgctgcgatgccctgcgcgatgcggtttcacgctatggttatcaaaagggtctgatactgcactccgaccacggcagccagtacaccagccaggaataccgggcggcgattgcggagtttggttccatccggcagagcatgggccgcacgcattgctgctttgacaacgcgcgcatggagagctttttcgcaacgctgaagaaggaactggtctaccggctcgattgctccaccatgaagcgggatgaggttcgcaagatcgtattccgctggatcgagacctactacaaccgccgccggcgcaacactgccaatgaactgaatctcccgccgctggtcaaacggattcgcttcgctgatcgtccgtttgccgcttaaggttttactcatgggtgtacggttttcttgactattccatctctccaagcgaatgcaggtcgcccagagccagcagccggtcaacctgttccggtatgttgtagtgatctgcaaggacttttccgttgtcgtcagggtatccattcaggtggcagaagatagtcaggtatggtattccagcagctttctcatccatttttctttgggaacatacagcataacgcgtccgctgaactcccgctttgcaactccctgttcgttgtatttgatactgttgttgcgggatatacaaatgccataactcagaaaccgggcaaaatctgaggagtgggtgactttcgtctttttctcagacaactccagtttcagggtttccgctaagaaattcttaacatatccatctgtgttacagataagctccagagcaaaatgccgggcgtccagccgctccagctctttggtgggggcgcgccctccatgcagggtcagatagtaattccacccaatttgttccagatcggagaagtcggtgacgactgttgtctgctggcagcagaaggtcaggtcgatgagatccttgatcccactgctcccgaactttaccgccgctgcctggaactgcgccgcctcctgatctgtgaagctgttcagacgctttgccagatagtccagctcatccagattcacgcgcccgcccgccagtcgtctgaggatggggcaggcgctgtccattttgctgattcggcagtcctgccgcacagcgtcccctagctccaacgcctccaactgctccaaaatgggttcatactcattgggcggaattgggaaggggacggctgcctcgccagattcttcatgctgtggatttttgagaactgcgttgaaaatcattgctttacctccgtttcttaacgacacacaatactgaaactgtgaggcaaagggaatacccaaacccaccacttttaccggcccatctttgaccgtcagtgccgctcggtcagctcctctacatcggtgcgcatacagctgccgtctttcccccagcaaaataaaaccatgatgggggtaggggcaaccctcgcacttatgggcggtctgtccgacagtcttgccataggatgcggggttgttttgctctgtatttatgtcgattacctcctccaaacgcaaaaaagcgccggggttttatctctagaaccccggcgcttacaaactcatgttgatttcgttttgatcggattggcgcatccgctctcgtggatttggaacattacgctcgatctggcggcggatatcctccagcagtagctggcatttgtccccggcataacaatgattctccttcctctgtaactttagcgccctttttcggaaaatgaaaacagcgtcctttttgaaaaatctcatttcaaaaaggacgctgtggatttctatagaattttggggttcggatccagccagcttctgtgaaccccctgtttggatcttttgttttaactgtgaaatttgaggtgcccccccccccgaaaagcccgataccatcggcatttctgccgatggtatccaaagtgggcatttttttggtggagacgaaggggatcgaaccctctacctcttgaatgccattcaagcgctctcccgaaccatcgggtatgcaccccctgatggcttgggaaaggacttgaatatcccgccccggcaattgatgagagacaaattgcagtatagcatggaaggtatatgttgtcaactggccatatcaaactttgatatgtacccctcgccgtggtcgtggcgagggtgagagcttattgcgccatgggcagttcataggtagcgcattcgttgatgctgtcgataccattcaggaactgctccacattaatgttgaattcaatcttgaccctatagtcccggaacaccgaaaccttcttgatgatgtagccgcagatcattttcttgacctccatcgggctttcatcgaaaatcttggaccaggacacgatccggttgaactcggccttcatctcctcgatcttagagtttccatcattcagttcctcggtaagggtcgtgattcgttcactggtggacagtaccttctgtcgggtatcctccagcatttcagtcagcacatcttgcggcagggcgcttttcccttgaatcgctttcagcacctcggccttgagggattcatattccttattggccttggtgttttcggctctggcccgctgcaattccgagcgtatcattgccatctgcttttgaaccgcacttcccacaatcatgtcgttggaagctccctgcatcttgtcgaagacctgatgcaacacctcagtgacgatcccgtccagaatgtgtattgtgtatccagtctgtcctgtacattcctgacggcgccgggtcttgttatagcatacatagcgaatacgttttttatggaccggcgtcccatccgcaaggcgggtggttgtcccgttggtagtgagcaccagtcggcctccgcagtggccgcagaagatgttcccggaaagcagggattggcctgcggtattcagcggtactgtgcgccgctctttccgctcattggtccgctccagcatcagcttctgcgccaggtcgaattggtctggggcgatgatctggagggcttcaaaggggccggcataggtttctccgctccgaaggattcccttgtagagcgggttgtgcaggatgcctcccacactggcatcgtgccagttttgtcccttccggtttttgatcccgtggtcgttgaggaagttagcaaggcgccatctgccgtaaccggacgaaatgcagagatcaaacatcatccgaacgactctggcctcatcctcatcaatgaccagcatgtacacctcatgtttgcgcttgttgaggatgccgctcttttccaaccggtacccgtatggtgcgtttccaccgcggaaccggccttcctctaccatctggccaatggccgttttggtgcgcatcgaagttttctggctctctccatcggcctgccagaaacggatgtagttggtcaggcgatccgtgtgggattcaaaccgctgttctccttcctgtacgctccagacgcggacgccctttttagtaaaccactccacaacgaaaggggtttcgtctgacttgcgtcccagtcggtcgaacatgaagacgagcagaatatcgaacttgccctgctccgcatacttcttgatgagctgcagtttatcacggtcatcggcgctgactttatagccggacacgccagtttcctgctcctcgcccacgatgacccagcccattttcgccgcaaaatcgtggcaggcttttctctgcatagggatgtctgcctggttgttttcatcgtgatcgacctgcttgttggtggaaactctgtatagacaataaactctttcagccattgatatccgtcctctcatgtttttgtgtgagagggcggacacccaatcattctattcgattatcaaggttcccagctttcgccatatccattatctcacactacggccagaatagccaggggaattgataatctttttggaggtaaatctgcagtaaatgggctggtgtgttgggttatcctgtactttgctcaaagtttttgggcctcatcagtctgccaaaagcgaatgtagtcaagcatgcgttctgcatcaacgccgtctatgatctctccctcatagacgctccaaacatggatgcccttcttggtaaaccactctacgatgaatggggtttcgttgagattgcgtcccagccggtcatacataaagagcagcaggatatcaaactcaccctgctcagcagcctttctaatgcgctgtaacttaacacggtcatcagcgctgactttatagccggacacgccgatctcctgctcctcgccaacaatgttccagccttttttctctgcaaaatcgtggcaggcgttcttctgcatgagaatgctttcctgatccttacctctgtataagcaatagactctttcagccattttactgaccatcccttcatcaaatcttctgaatgcaagaccttcagcaagtcgttctatttttggggcattgcataggaactcagaagtgcctgctttaccaatacggcaacttcaaggttttccttttctgcaaagcagagagtgaccttatagccctgaactgtgatatgcatttcaggcttttcctcatcgattctgagtatcctgttcatcgtaatcctcctaaaaataaagcatcggctattctaaaaagatagccgatgcttctcaatttctaattgtagctgcttagtggcgatagtccttttacagagtaggttcgattgactgagtaccagtttcctgtgcttggacgatgtccaatgttggcagagctttcagataattctctacattccagtattgaaccccattttccatctgcacatcttcgccacggtacaggatatagcgtccctggatggagccaaatcgccgttctgtcctccggcatttatcctcatcgacgaggtgccggtattgaaggggaacttgcttgctgctgtgtttgatttcaaagatctcacagcagttttctttctggtcatagatgaccatgtcaaactcgccagcctcaaactgcagtttgaaaacacggtgatccttgtcggctgccttcatggtttccagcagcacaatatcttccatcatccggccgcggacttcttcaagaatgcggcccgtgatctgcgttttatcatattcgctgagcgccgagaaccgctcatctttcagcagagaatggacaagggcctgagtctgacaatatcgcattcctggctgtgtaaagagaatatgttcttctggttcaatttcgggatctgctgcctcgatggggcaattcacgatcaactccagcgcggagagatactgcttgatctctatgatgtgggcgaccgtgatgccgatggactgatcctccttgttccggatatccagcagttccatcaaacgccgggtgaccgcctcagtgtcaatggtatccagaacctctgtgcgcttttggggatcgcgctctttccgcaggtttgcagcagtgagccgtaggtcgtgagaggcgaaatcacccgtcagcaccgagatcaggaaacggtggttcatgtcctcaatgattcgattaatggctccagtcagttctccggcttcgtataaagagtacagatggcggaaatgtcctcctgtctcatagcaggccagggagtgctggatgttcttgcagattgccgtgtcgatgtatcttcgggtggactcgtcatcccggaaggatgcatcctgagcattcacatcttcatcgtcaaaggccaactctccggcgcgtagtgtgccgccatatcggatgtactcatcaatgctgtcgatcccgagcagacggctatactcccgatatgggatgaaggtcgtgtggatggacttggcccggtcatacaattcttcatccatcgccagccagaagcccagggagtcggtaccggacaggacgatcttcattcccatggtggcgaacacatcggaaaagagggcagccgagtcaataaagtcttccatcagcgtgacctcgtcaatgaacacatatcggaatcctgcgttaaacaactttttgagatcctggttcatcatcgccatgttgtcagtcctgcggactttgatgtatgcggtacggctcaagtcctcctttgccattctgccaatggcctggcggagcatggtcgtctttccggttcggcgcagcccgaagatcaaacagacgcggtcgctctccttgctgtagaggtactcctccatttgctcaaagcaatcacgaagtccccaatcctttacgccccgcgacatggcctccagacccctgccggcaatcacgctggtttcaaaatccaacttgggctggcgcgctttcggcatgccggattgcaattccttcagttgagcttgaagggacttgcgccgatcaatttgttcctgcaatacctccatctctccatctcgaagatattggctgtgcttttttctgttctctgtccactgatggtagtatcggactttgccgttgatcgtcttctttgagatgtaaccaatcggcaggccggcgatctgcctttccaattcctgaatcttttcctgtcgtttcaaatcatccatgtcgcacctccattctgctgtattttattataccctataaccccaaaatgttcaaggggttataaggggttacgcactcatggtagattaaagaagcccacgaatgcactcgctttccagttcgacgatgtcgcctatcggtatccttaagccatcagccagaatcagtacctgatccgcctcatggattcttttcagcctcccggttgatacgatataccggccgccgtctttcttcgcgtcaggctggaaccaggtcaccgtgatttccggccgctctttgatccgctccaacagcagttgctgttttaagtccaaggcagccctggcatcctcgtccagttccatgcgctggtcagtcagccgtgccgattccgcaagggcggcgctgtggccggacagggccgcaaagggcgcaaactgggccgcacggtccgagagcggcatccttggatgcttggctgaggtagggtgcggcaggttgatgatatcgtcataaagtgcccaccagggccatttgttggccctggtggggatgcatatggaaaagatgatcaaagttcgatccttgatttgctggtcaaacggctataggtggcagtctgttttacatttccctacaggaacagtttttttgtgattgtacgaagtgtgtcacagctaagtccagtaccctcaaagagcatgaaataggtcacggcttgtagcacccgataaaccgcccattccttttcacctaccggatctatatcaccatgtgcgattttattcctgtatttactgtatatttccccataggaatttaactctaaatggaactctttttcgttggctctcaacaagtcgctaagttcttctttgtatttttcttttacaatgaaatcaacaatttcttttaagagcccttcgtagcgctcgacttggcttatgcagtcattaagatatttctgctctcctttgctcatttgcttttgctcgatattattcaaagccgtcaaagctaccttcttcgcggtccgaaattgctctttcttgttctgcttgaaatcaggatagcatttcctgaacaatccctcaaaggtcgttgctttcaaaagccaccggctggcatcgactcgaattcgttccttatagtttttagggaaataatagcataatcttttatcattttctcgaagacctgcaatttttgaaaactgtagctttgcgcgcaaactgcaaaattctttcatacaatttgcaaaaaaacggcgcttaaaaggtttacaaaaatctgtttggattgtgtatgcgtttgggctttcccggcaaatgaaacacctgcttccacaaaataagcctcgggataaatccgctgtttcccggaatcgtctgtgcagtacagatacggcgtgcggccatagtaagcgatgatgcattcataaaggcggcctgccgtcagccggttgcgcttgttgcgtgagcatatgtaaaaacccacaaatgacacacctcctgcttgattgataaggaaagggcagcccggcgcgggcatcatcttctatctaagcttcatctaaaatcttgcgccggagctaaataaaaattgcgaaaggccgcgctttttgtcgcgttttcctttcgcaattaatattacaattttcaggcgcagcctatattcaaaaagcacttgcaattttttaagaacatggtatgataaaaacatactcataggcagagtaggaaccggcgcgttaagtgccgcctgaacggggagttgtcaggcggacgaaaagagtttcttgcggtgccggtttcgcatcccgctgctgcatccaaagagcatatcctcttttcatgtggcattgatgttgcatgaaaggaggtttgttgtttatatggaaaaaatttcaagttatctgtgcggcgtctggtccgatattgcatcggtgccgcgcctgacctgtgaatccgcgcgggagatgcgcgatgtgcgttcactggccggctcctctatgttgacggcgttaagcgttgtgctcaatcagtttacgatcttttttacccaggttctgcgcctgagcgtgacgtttttgccggttgcgatgtgtgcgatgctgtatggtccgctgctgaccggcgcgatgggcgcggcggtcgatatcctcaagtattttacccgcaacgacggcagcgcgttttttccgggctttaccatcagcgaattcatgcgcggctttctttacggcgtctttttctatcggcgccgggtgacgctgccgcgtgtggcggcggcgcacctgtccgtagttgtcatcgtaacgcttgtgctcaatcctttatggctttcgatcatgttcggcgatgcgtttatcgcgcttgtatccatgaggcttgttaaaaatatcgtcatgtttccgatcgaagtggggctgttgtatttcctgctgaaaaagaccggcgaaatttactcccgcgcccggtcttccggttattatgcaaagaaatcccaatgataaaaaaagaagccctgcggggcttctttttttatagattgcgatttgcaatctataaaaaattggctatccgggccggagccagtttgcctggacgcgcaggcagcgggcagatgcgccaataaacagttgcatgcagcgattaaaaaagtcaggcgtcagacgattacattctgtgggtttccttcaagaaagcacaacagattatcggctgcggcgcgcagaaggcgtgcgcgcgtttcacggggcatccagctgatatgcggcgtgcagataacgcgcggatgacgggcaagcgggctgtcgggcgcgggcggctcgtcgcaaagcacatcaagccctgccatatatagctttccgcagtcaagcgcatctgccacatcccgttcgcagagcaggccgccgcgggcggtattgagcagcactgcgccgtctttcatgcgtccgatggcggcgcggtcgatcataccgcgcgtttgtggcgtcagcggacagtgcagactgacgatatcagattgcgcatagagcgcgtcgagagcaacaaagcggatgtacgctccggcggaagggtcgggatggcggcggtaggccagcacccgcataccgaaagccgctgcgatacggccgacggccaagccgatgtcgccgcagccgatcaggccgatcgtttttccggcaagctcgaacatggggacagacaccagggcgtgatcggtgggatcggtccagtgtccggtgctgacgtaacggctgtgtatgtgcgtcatggtggcgatattgagcagcagggagattgtattctgcgcgacggccgcagtgctgtaggcagggacgttgcagacggtgacgcccgcccggcgggccgcgtcgagatcgatcatgttgtagccggtgccaaaggtaccggcaaaacgcagggatggacaggcttcgaacacccgcgcgtcgagccgcagccggttgacgaaaacagcttcggccgttccgatgcgttcgatcgtttgttcaggcggcgtgttgtcataccatttaattttgaatgtatcgggaagcggcaagccatttaaaccatatcctgcgagaaaaccatccaaaacaacaactttcatgaaaaattcccccgtttgcggtaaagaatagaatggttggaaaaatctgcgcaggtttgattgtagcagacagtgcggcggctggcaagcacgccgccgaatgttaccaaaatgttaaatctaattttattagaaaaaaggggttgatttttagaaattttgtattaaaatagtcttagcactcaaatagaaagagtgctaaggattcgtcgctgtaaaattattttatataattggaggagttcattatgacgattaaaccattggcagaccgcgtagtcacgaagatggtggaagcagaagaaacaaccaagagcggcatcattttggctggttcggcaaaggagaagcccgaggttgccgaggtgctggccgtgggaccgggcggcatggttgacggcaaggaggtcacaatgaccgtcaaggtcggcgacaaggtgctcatgagcaaatattccggcacacaggtgaaggtcgacggcgaggaatacaccatcctgcgccagggagacatccttgcgatcgttgaataaattcccacattttatttagaacaggagattgatggattatggctaagacaatttgctatggcgaagaagcgcgcaaggcgctccaggccggtattgacaagctttctgatacggttaagatcactttgggtcccaagggacgcaacgttgtgcttgataagaaattcggcgcgccccttatcacaaacgacggcgtgaccatcgccaaggaaattgagctgtccgacgcatatgagaacatgggcgcgcagcttgtcaaggaagttgcgaccaaaacgaacgacgcggccggcgacggcacgacgaccgccacgctgctggcgcaggcccttgtgcgcgagggaatgaagaacgtcgcttccggcgcgaatccgatggctgtcaagaagggaatcgccaaggctgtcgaggcggctgtcgaggggcttaaagagaactccaagaaggtcaagggcagcaaggatatcgcacgcgttgcgtccgtttcctccggcgacgagtttatcggcgagttgatttccgaggccatggaaaaggtttccgcggacggcgtgatcaccatcgaggagtccaagaccgccgagacgtacaccgaggttgtcgagggtatgcagtttgaccgcggctatatcacgccgtacatggtcacagataccgagaagatggaagcggttcttgacgacgcttacatcctgatcaccgataagaagatttcctccgttcaggagattctgccgctgcttgagcaggttgtccagggcggcaagaagctgctcatcatcgccgaggatgtcgagggcgaggctctgtccacgctgatcgtcaaccgcctgcgcggcacatttacctgcgtggccgtcaaggcgccgggctttggcgacaggcgtaaagagatgctgcgcgacatcgcgattctcaccggcggcgaggtcatcagcgaggagcttggccttgagctgaaggaaacccagatgtcacagcttggccgcgcgcgtcaggtcaagatcgagaaggaaaacaccatcattgtcgacggcgcgggcgacagccaggctatcaaggatcgcgtcaaccagatccgcgcccagatcgagacaaccacaagcgattacgacaaagagaagctccaggagcgcttggccaaactcgccggcggcgttgcggtcatcaaggtcggcgctgcgactgagatcgagatgaaggagaagaagctgcgcatcgaggacgcgctgtccgctgcgaaggctgctgttgaggaaggcattgtcgctggcggcggtgtggcgctgctcaacgttatccccgaggtcgacaagctgcttccgtcgcttgacggcgacgaaaagacgggcgtcaagatcgtccgccgcgctctggaggagccgatccgtcagatcgctgacaacgccggtctggaaggctctgtcatcatcgataagatcaaacgttcccgcaaagtcggctacggctttgactttgcaaaagagatctatggcgatatgatcgaaatgggcatcctcgatccgacaaaggttacgcgcagcgcaatccagaatgcctcctccgtcgcttcgatggtcctgaccaccgaatcgctcgtcgcggacgagaaggaagaaaatccggttccggcggctccggccggcggcatgggcggcatgtattaatcggatatccgcacattatcatagaaaaaagaccgctccccacatggtggggagcggtctttcaggtttgctttcaggtttgctttcggatttgcccgctgcacattatttttttctgtgcgccgtaataatggtgtagctgtgcgcgtttaccgttatgatgcaatgatccgcatctatgtaccagttctttccggacctggtgacgatagcattgggcgcggagatttttgatttgcaccaatcgacggcctggcccgtatccagggaaaggttgctttttatgcgcatggcgcccaattgggtcgtatgcagcttttccaggttggcaaacagttcttccatatagcgtatcacctgaaataatgatatcatattgcgcccgcagcctgcaagaaacgttgccggacacaattttgcatgggaaccgcggatgcaaaagtttacagtgtttcgctgttttccgaccggaaaacatgctatactggctgtatgacaaatgcggcgtttgggcgcacgcgggacaggagtgacgactatgcggattgtaacatccgggcagatgaaaaagattgaggaaaatgcgcttcattatgcgctcagttatgagcggatgatggaaaacgcaggcagcgctgcggccgccgccatccgtcgccgtgccgatatcagcgggcggtatatcacgattttctgcggccgcggcaataatggaggagacgggtttgtcgccgcacgcaggctgtatgaaagcggcgcgaatgtagcggtgatcctgaccgacggcgcgcctaaaacgggacaggctgcggtgatgctggaacgtatcggcgatatggatattgcggtggtcgcatatggcgaggaccagctgtatctgacacagcgccttgcggagacggatattttgatcgatgcgatctatgggacaggctttcatggagagcttgacgaacgccatcgcgatatctgccgcctgatcaacggcgtcgacgctgagacgtacgcgctcgatatcccaagcggggtcaatgccgatacaggatgggctgacgaatgtgcggtgcgcgccgatgcgacggttgtattcgacagtgacaaacccgccacggccatgcccgcggcagccgcctggtgcggtgaggtgatcgttgcggacatcggcatcccgccggaagcgcatgagggaatcgaacgccagtttaccctggtggacgcggcatatgtgtttgggcgtctgccgcgccgccgccgcgatacgcataaaggcgattatggaaagcttctcaatgtggccggttcgcagcagtatatgggtgccgccgtgttatcgacactcgcggcgatgcgcacgggcgcggggtatgtcacactggcgtcgaccaaggaggtctgccgcacagtgctgccgcttttgccggaagcggtgatgcgtccgctgcgccaaaatccggacggttcgctttcgtggcaggcgatggatgagctgcgcagcgcgatggagcgtgcgacggccattctcattggaaatggacttggaacaggagaggatgccgtgcgcatcgtcagcgaggtcctgaagacggccagttgcccggtcgttgtcgatgccgatggaataaatgcgcttgcacggaatataaatatattgaagcgggcaaggtgcgacgtgattctgacgccgcaccttgcggagctttcaaggctgaccacgctgccggttgaacagctcaaggcggatgtattgacagcggggcgggctttggcatgtgaatatggcgttacggttgtgctcaagggtgcgtacacgctgacagccgggccggatgggcgcgtatggatcaatacaaccggaaacgcgggactcgcgaaggccggaagcggagacgtgcttgccgggataatcggagcgctcacggcgcaggggcacaacgcgccggaggcggccgcctgcggcgtatggcttcatggactggctggcgattatgcggcggacagccattcacagtatgcaatgctggcgcgggatgtgattgatgcgctgccgcttgtatttgcagatcatgagagataaagcccggccgggctgaccgcgccgggatgtggaggtgcgtttatgcgcggacggattggctgctgcatcctgctttgtgcggcgcttttatggaccggaaccgggtgcgcccggcgcgatcaacaggaacaggcggaaaatctggccaggcagagcttgagtcagaattttcagacgacggccaaggtccgctacaagggtattgaaacggtgatgaccatctataaaaaaccgatgaactgtgcggtcgtaacgtttgaagcgcctgacagcctcagggaaatgaagatgacgttttatactgatcatgtcgcgctctcctataaagatctgtcattcgatttcacaccggacagcgttcccggaaaggctgcgtcaaagatggtgctgaccgctctgaatgcggcgctgaatgacgacggtatctctgtacgtgaggaggaaggacgtttaattgttgacggaacgattgatgcgggggatttttctctgatcatagacgcggaaaatggaaatatcctgaagctgtcaatgcctgaaaatgatcttgaactagaggtgctgaattttaaatttcttgaataaaacgtttatttcaaaaaggcccgcgccgattggcgcgggccttttgctgtcagaaaacaaggggtggcaatagtatataaagggcgcgtcaaacccttttgcatggattgtaaaacaacgtatgtaaaatcgtttgttcaggatcagtgatagccctgagccatttaaacctgtcgcacgcctgcccagctggacggcaggcgcgcaaaaaaatagatgtaaagcaactattttttgtcaacgctgtttaaaaaacgcacaagacgatcaaaatatggatgcatgaacatgcaatatacttcagcgcggctgctggttcgtttgagagcttgaaatcaagtaatgaaacggccctgaaccgccaatcgccacggagagtgataaacgtgaccgtaaaaaggggagacatctactacgcggatctaagtccggtggtgggttccgagcagggcggcgtgcgcccggtgctgatcgtacaaaacgatgtgggaaatcgatacagtcccaccgtgatcgctgcggcgatcaccagtcagaaggataaatccaagctgccgacccatattgaaatcaattcacaggtatgcggcctttctcgcgattcagtcgtgctgcttgagcagatccgtaccattgataaacggcggctgaaggaaaagatgggcaggcttgacgacggctccatggggcaggtcaaccatgcgctgtcgatcagctttgggcttgacggcttcggcaatccgcttgcgcctacataatacttacgtaggcgaaccggcgccccgtgaatgcactgtgtataaaaaggctggcgcttttcttgcgccggccttttcccaatcgtaaaaagagaaaaatgataccttattatatatacgcaatatccccaccgcagatatcagcctgcggtggggatattgtcaagtcaacacgatattgttaaatccggcggcgcgcgcgtaatcggcgtgcgcctgcatggtttcaggggaaggggagggcgtctcggacaagcgtccgcgcacgccgtttttgcggaaggtgatcagcttaagccgcgtctgggtcctgcgcggaccgattgtccttgcaatcccgtcgatcgccgcacgcgtatcgaccagctcgtcgatacagacgatgcggatttcctccagcttgccatgttcgctgagaaagccgagatttttctttacgttgacgttatcagcgcccgtgagcgcacgatgcacctgactgtcccaggctttgacatcaagcatcacgccgtcgcagacttccatcagcgcgggatatgcagccagatcaacaatgccgttgctgtccatcagacaggtaaggccctctttctgcgccattgtaaacagctctgtcagaaagtcggcgcgcagggaacattcgccgccggaggtcgtgatgccgcgtataaacggaatgtttttgcacacctcgtccatcacctgctgcggcgtcatggttttgacgcgcggcgaagccagatgcggacaggtaatgatgcacgcgtcgcattccacacatttatcaggatcccatacgacgcggccatccgccatggaaagcgctccttccgggcagcccgggacgcatgcgccgcagttgcagcacatattctgcgtctcgggattgtggcagtaggcgcaggcgatgttgcacgcctgaaagaaaacagaggtgcggctgcccggtccatcgaccgtgctgaaggggatgatgcggttgaccggcgctgttaacgtcatgccatcctgacctttctctgcgcaaggcggtttacgtcgtagtttggagcgcccagatgcgtcgtgttttggagcacaacctctttgttgcggtatttttccatttcgctgcgcttgacaagataacctgtgatgcgcacgagatcggcgtcgccggcgtagaagctcatatagtggacgccggtctggaacgcgccttttacaacatcaagcagtgcggccggattgcggctgacgttggttgcgatcgggaagatatcgcccacacccgccgggaaatacttgtggaacttggcgcaatggcgcagatgctcggcaaaggattccggctcatcgccgaccgggatgcgcacgccggaggtgatgccgagatcggaatcaaggccgacctgcgcgtgcagcatgaacttgccgccggtgatcggggaatactccgcgtcaaagccgctgacaatgcgctcaatggcatccatgatgcgcacgccaagcgcgtcggcgtcgggatcgttgccgtagagcttgccggtgcccttcaaaagcgtgttgacaccttcggccagaccggtgacgccgaacataccaacaaagcggtccttggagagcagcccctccttgacgaggaagttggactcgaagaaaccggactgctcgacgatgaaacggatgcgctcattcatgtagtcggcgatgaggccaaggcactcggggagcagctcattgaagaaatggtcaatgtcgcgcgcctcctcggcgagttttgtcagcgtgatgcgcgtcagcgtgtaagcgccgccgcgtgtcgccagaatattgtagcagcttgaaatgccgtagtcgtcgaaagtgtccttgttcgccttgtggttgcagatggcgggattagagcagacgagcgagcaatcgatcgccgcctccatgaaatcgtccggcgtgatatccggatcgtatttgatcgtcaggttcggcacagcgttctgaagctccttttcaacctggaggatcagccagcccgcgcgcgtggcctcgggtccgatgtttgcatggcagaatgaatcggtgattgtgcggtcgagataggtcatgaacaggcgcagcttcttgaggacttcctcgtcgctgagaccctcgatgaacggatcgatcagcttgtcaatatttccaaggtaaaccgggaaattggtgatggaggggacatggcgataaaggatcatgagggaatagagcagctcatcaagatccttgggcggatcaaccttcaaaaaggcactgccgttcttgacaaaacgctcgtaatccggcagaatataacgcggccggtacggcgcgccgccttcaaacaggtcgttgatcgcgccggtgctgaaatagtggcgcgcgcgctcggggatattgagcacgtcgagtccgttttcggcgcatttggccaactgcatcagcttttgctcatgggttagagagcgggatgaaacaattttgtaggcgttttccttgtcaaacataacctttacctccaaatttttaatggccgccgtcttgggcctgtatgcgcatccagttcgatacccgtacagggattacctcaacgtgcggtgttcaagctcggttgagagcatttcgtactgtttagctgtcagacggacctttccatgctgaatcgtcacaaccccttcctccgcaagcctatgcaggctgcggtttacagtgcgtgtgcaaaagccgatctcctcgctgatggcgggccgcgtcatggcgaccgtgacagccgcgccttttttggcgtttttttcgtagtagcgcgcaagaaactgcatcatgcgcgcggtgccgtcgagaaagagcgagcggcgttcctgcgcagtctgccggacaagtgtctgaaggacgctgcgtacccgcgaaagaaacatgcgtccgtcgcgcatcatccagtccatataggtctgtgcggaaatcatgagaaagcggcagcgtgttttggccttgacctcggccaaataagaggtcatctcgctgagcacttcatattcgccgaacaactcgatcgcctcaaagtcccaaaaggcatacgtgttgtagccgggctgcgaagcgagcgtggtcgtctgcccctccagaagaatgtataccgctccgcaggggtcgtcctggcgaatcagaaattttccggccgggagtgtaagcggcgatacaggcgcatcagcgggaaagttggcaaagaagcgttcaagctcactgcgcagcggctcgctttcccgtgacagatagtccgccaatctcatttcgccacctcctgaatctaattataattgggcatgccggcaaaaaaaaggacgtatgtccttaaaggtgatctttggataatcgcacaattatatacgtcaagctatgggcattgtgccaaacatcgcggttgtgttatttatgagttgcagagttggccgccatttgttataataattacacaaaatatggagcatgtatttgtttggttaagcggcggataaacaaatgtttatagcaacatcaacaaacatttgcttatgctttcagaccatatggtaaaatattgtttcttgactttacattttaaaattttatgatatactaaatgaaaaattgtcaatgtgaacaataattgccccagaagatcgggtgaaacatcacgaatctataaaaatatagttaaagcctgcttgtgttgtttgataaatattgttcattgaccatcgcctggaggatacaaatggataaacaggagcttattaaacttgcttttgaggcgcgcgagcacagctattccccctattccggcttttgtgtgggcgcggcgcttttgacatcgggcggaaaggtttatcagggctgtaacgttgaaaatgcgtcgtatggcgcggcgatctgtgcggaacgaaacgccgcgatgaaggctgtctatgatggagaacggcgtttcgaggcgattgcaatctgcggatatccgcgcggcggccgtccggaggatgccggctttgcatatccctgcggcatctgccgccagtttctcagggagttttgtgatcccaagcagatgaaggtctatgtcgcgcgcacgccggacgatgtgttggaggcgacgcttgaggacatgatgccgcattcgtttggaccggaggatctgatcggcgacgtgccgggcgtgtgaacgcgctcgcccgtggaagtttgttcacccgtcctttttacggacgggcgttcataaaaacatccctcatttggggatgtaaaacactgtaaaagcaaaggagaaacaaaatgaaaaaactgctcagttctgttttggcagcgatcctggcagccggtatgctgaccgcatgcggctccaagccggctgaaagcacgacttcgcaggctccggccggcgacgcctcgactgcgcaatccgctgcgcccgcgggcgacgaggcttccgccgcagaaggcaactcgaccgccgcttccggcgatttttcagcagcgatgatcaccgatgtcggcggcatcaacgacgaatctttcaaccagtccgcatggagcggcatggagcagcttgaggcggacaagggcgtttctgtcagcttcctcgaatccaaaaaggatgccgactatgcgccgaaccttgaaaagaaaacagacgaagctcccgacatcatctggggcattggctatctgatgaaggatgctgttcaggcggccgccgaaagctatccggatcagctctatgctctggttgacgatcagttcgaggaaggcgctgtcccgaacgcgatcggtgttgtgttccaggcggagcagtcctccttcctggccggctatgttgcggccaacaagaccgagacggatcatgtcggcttcattctcggcatggattccccgacaatggaccgcttcaaatacggttatttcgcgggcgttcagtatggcgcgaaggagcttggcaaggaaatcccctgcgagtatcagctcgctgagagtttcagcgactccgctaagggcaaggcgattgctcagaagatgtacacggacggcgttgatgtgatcttccatgcggctggtcagacaggatccggcgcgatcgaggccgccaaggaaatggacaagatgatcatcggcgtcgacctggaccagaactggatggcccctgacaacgttatcacctccgctcttaagaatgtcggcaatgcggtttataacgtcaccgagcgcgtcatgaacggcgagcagcttggcggcacaaacgtcatcatgggtcttgctgaaggcggcgtaggtcttgccccatcctccgataagcatttgtccgccgagcttctcgcaaaggtggatgagcttgagcagaagatcatcgccggcgagatcgttgttccttacactgaggatgactacaatacgtttgttgcgtccctgtaagaactttacccggactgttttgtccgtgtaagataactgttttggcgtcgggacagcccgtgcgcaggcattgcctgcgcacgggaacgttccccggctgagacagtttttttttagaaaagttttagaaagtatccccttaaaagggggtgctggcgcgggctcggtattgataagccatgcgccgacggcttgctttggcttatggctgatcaatatggaggacgcggctgtgcgtctttcgggaaacctgcaaggaggaggatgatgattatggcagcagaaaaccctcaatacgcagtacagatgaagggcatttccaaattctttggaagtttctgtgcgctgaaccacgtgaatttggatgtcaaaaagggtacgattcatgccctacttggcgaaaacggcgctggaaagtcgactttgatgaatgtgctttatggcttttacagagcggagcagggggagatttatctcaatggagaaaaagttgatataaaaaatccaagcgttgcaatcaggcatggcatcggcatggtgcaccagcactttatgcttgtcgaaaatttcactgtgacacagaacatcatgcttggcgccgaaacgacaaaatcgctcggtgttcttgatatgaacgccgttaaaaagcagttgattgagctttcggaaaagtatgggctgtatgttgatccggatgcgaaaattcaggatacgtctgtcggaatgcaacagcgtgttgaaatcctcaaggcgctctaccgcggcgttgacatcctgatcctcgacgaaccaacggctgttttaacgccgcaggagattgaggagctgatagcaatcatgcaccgtttgaccgacgacggtaagacggttatcattattacgcataagctggctgaaatcaaaaaatcctcgaattactgcacgatcattcgtcgcggtcaatatatcgatactgtcgacgtctccaaggtaagccaggaggatctggcaaccatgatggtcggccggcaggtaacgctgcatatccaaaaggaaaaagcaaagcctggcgatatcgttttcagcatcgataaccttttggtgcgcgacgcgcgcgggatcgcaaaggtaaacggcttgtcgctgaatgtgcgtgccggcgagatcctgggaatcgcaggtatcgacggcaacggccagaaggagcttgtcgaggcgatcacaggcctgacaaaggcggagagcggtacgatttccatcaagggcgatcagatacaaaatacgccgccgcgcaatgttttggatcacggcgtatgtacgattcatgaggacaggcacaaacgcggccttgttttaaattttaccgtggcggaaaacatggtgcttgaaaattaccgtaaagagccattcagcaaaggcccaattctgaatctgccgaaaattcaggaaaatgccaaaaagctgactgaagaatttgatgtgcgccccgcgggctgtgaaaagacgctggcccgtgcgctctccggaggcaatcagcagaaggttattattgcgcgcgaggtgacaaacgatccggagctgctcatcgccgtacagccgacccgcggacttgatgtcggcgcgattgaatttgtgcaccgttcgcttgtggagcagcgcgacaagggaaaggccgttcttttgatttctctggaattggatgaggtcatggatctttccgatcgcatcaacgtgctgtatgatggaaagattgtaggagagcttgacgccgaaggcgccgatgaaaatgaaatcgggcttctgatggcgggaggaggcgcacagaaatgagatcgaaagtcgtaagtctcttgaaaaaaccgatgaccggcattatcatttcggtgtttgtcggcttcattgtgggggcgattgtcctcggagccgccggatacaatccaatcgaagcatatgggtccatgtttggcggtatgttccgaaaaccgaaatatgtttcgcagatcatcatcaacgcgatcccgatcatcctgaccggcttgagcgtatcatttgcttttaagacgggcctgttcaacatcggggcggaaggccagtacataatgggtacagtaacggccgcgatgcttgggtattatctttccttgcccggcatcattcatccggcggttatcctggttgcagcctttttggttggcgggttgttcggcgcgcttgccggctggctcaaggcgcgtttcggcgtccatgaggtcatctcaacaatcatgctcaactggattgcgctttatttcaacaactttattctgtcgctgccgggtgtgaaaaagaccggaacgcaggcgtcaaatgaggtgcttgagacagcgcgattgacctttatgggggcgtggaaaaagtcggatgcgggaaaggacttcatccgcaacaaccccatctggggcgacttcatgcgtactgatgttcattgggggattttgatttcaatcgtcgttgtcattgttgcctggtattttttaaaccgtacgacaaagggcttcgagcttagggcggttggctttaaccagtatgcggctgagtttgccggtatcaacgtcaaaaagaatacaattattgccatgttcattgcgggcggtattgccgcactggctggtgcaatccatattcttggtaccaaccccttcaggatcagcgttctgccaatcacggaaggatatggttgggatggcatctccgtttccctgattgcgaacaacaaccccataggatgtattctgtcgggcctgctgttcagcggacttaactacggcggcggatcgattcagtcggatatcggcgcgccgagtgaaatcatcgacatcatgatcggctcgatcgtattctgtgtggcgcttgtatcgatcttcccgatgattgccgacaagatcaagagaaagggtgacgcacatgctaaataacatcttgctggcgatcaatatcacgctgatgtattccgcgcctttgattttcgctgcgcttggcggcgtcatcacacagcgttccggcgtcgataacatcggtatcgagggtatgatgacctttggcgcgtttgcggcggcggcggttggctattttacagcgaatccatggcttgggtttttggccggcggtcttgccggcgcggcgctggcggttttccatgccgtcgcggcgatccatttgcaggccaatcaaacgatttccggcgttgcgatgaacttcatcggcccggggcttgcattgttcctttcccgcatgttttttgagggcgcgacacagacgaagccagttccgaacaagctgccgaaaattctttcgatgctcgggcttgatacatcgaatctgaccattaacgccatcaacatcgatatcacggtgcccattgcgtttttactcgtactgatcatgtggtttttcctgtataagaccaaatggggcctgcgggtacttgcctgcggcgaacatccggccgcggccgattcgcttggcgtcaatatttatgtggtcagatatgtctgcacgatcctttccggcctgtttgcaggcttcggcggagcggctatgacgcttgcggttgtcgccaacttcagcccgaccgcaatttccggtcatggatttattgcgttggcggctgtcatctttggaaaatggtcgccgcagggcgcgctgcgggcttgcctgctgtttggctttgcacaggcgttggtcgtgatgctgggaggcatggattatatcccgtcgcagctgcttgcgatgttgccgtatgtattgacgatcatcgttctggtgctgttcgttggacgttctgaagccccaaaggccaacggaaccccatatcgaaagggagaacgttgatgttggctcattctgttctttgaaagaaaaactgtcccaatattttatgttgctgcactggcaacagcgaataaagctgataataagaagcgcggcgcctcccttcggagacgccgcgcttcttgtcatattaagaatgctcccctgcatagatcaagatatcatggcggcgatgattgaaaacaggtcaggatatgttccagcaaaatctgttcggcactgcacagattctttcgttcgcgatgaagcacacagagggggatctgattttcatcattaaaaccgcttatggggacaactgtcaaacgatcattattgatatcttcatcacagaaaataggatagcggcataaaatagaaaccatattttgctgggcgacagactgttttacctgatctacatattttaaatagataaagcggttgtttttcaacagggtggtatctgaatcggtcaaaaagtgagacaacagggcaagcgactccttctgaaaatcctgtggcataatacaatcccttgccgccagaggatgtttgagcggcaacagggcgcatagtttatcctgaaataatacatggatacaaacgttatatttttttgcgataggtttaaattcctccaaagccttgcggctgtaataggtgatgccaatattcgccgcattttgtataatgcggattcctacctcctcgcctgttgtttccttcaggttcagggtgatgtagggatgatctctttgcagtatcgcattgagcgggagggccagtccacagatgatgctgggtgctgccaacaatgtgacggtccgttcactctgccggtccgcctgaccaatctgctggatacactcatatatagcacagatttcttttgccaggcttaatacggcctcgccgtcgggcgtaggtgcgacgcctccaatcaaacgttcaaatattttaaacccaacttcagcctccacatttttcaggatagtgctcaatgtggtctgtccaagataaagattttgagcggcgcctgaaatggattgacaccgctcaatctcgatcaaatcgcttagatagtcaagacgcacaggccgtcacactccttcatcgtgagggttcctctgtggcaaagggcggtggggtaagagaggaaaaatattcctctatacagcttagaaaaatacgctcctgataacgcagccgttccttggcgtgataacatacataaatattaatttttccctgttcctctatcccggacagagttcgaatacatgccttgctccatggatagctttgatcctcacagatggcgtagccggtcagaatggaaaccatcttttgttcctccacggcgcgtttgacaattctgatattgggaaaggatgtgaagcgtcccgcgcttcgatattgacggctgacggcagcgtcaaagagaagggacagggaattgccgtcagaaggaaagcaggattgaccgacgtcaagcaagttgatatgttccctgtccgggataaaacgaaaatttgttgcaaccgcgacattttcttcacaaagcctgtgaacgtccaccacctcctgtgtccccaacgggctgtccggaggaagaaatgcataaaagcgatctctgtagagcagcttgagataaatttgctcgtgagccaatggtatctccaaccgcttggcgtcctcctcggtcagataggtgattccgatatttgttagcctctggagtatttgcgggaggatttcaagccgggggcattcctcaaagaccagggtgccataattgaagaattgataaaatcgctgcgccagagggagggcagctcccagattgatgctgggcgcgcataaaatatggattggatcgatgcttcctgaaacccctgatttgagacgcaaaagttcctcaaatctgacatggatttcaccgcccagggtcagaaattgctccccaaaaacagttggggcgacgccgttgggtgttctctggaagatcggaaatcccaatgcgctctccacgttctttacaatggagcttaatgttgtctgcaccaagccaagcgaccgggctgccgcggagatggaacggcagcggtcaatttccagcatatattgaaaatgctccagatgaatactccactcgcctgatcgtatgcaccgctcggtgttcatgccgatcctcccgttccgatgacatttggtctatttgaccaaatgtcaaaccattatacgtcttgttgtttgttattttaacgtaaatatgagagattgcaaatagatatttataatattacggttgattatatcgataaaagcaggcggctgatacaaagactgtatcggccgcccgccttttgactcggtggaaagatagggttttcttaaaataggctgctgccgtttacattatcttttgaagccgcgccttaaatttcttttaaaatctgttcatagctcatttctgccggaaatcccaaacgttccaatgtcctgccgtgtgtttccagatagtcccggtcgttgatcgctcccgccacccccagaaaagcggtcagaacaggcaattccaatcccagccgtttaccggctgaaacggcaaaagcaccgccgcagccgcagtcttcgtggagatagcggtggtcaagggaattgggaccgttcatgtattcatagaaagtcgctacctccggatgttccttaagattcaggacacgttcgatcatatccattgaattttcatgctcctgcattcccattgcatggataacagcctgtcgttccagtcggattttggtgatgcagtgcacagcggcaggggtaaaggcatatttgaacagggagaaatcatctcccctgcggtcaacctccgccgcggccaggagcgtgctggcgatatggttggtgacattgccggcattgataacgccttcaaatacgttgcggttgggcacatattccaccacacctttcagagcttccagcacccgcccggtgtctgaggcgggcagggaagcggcccggccttctgcgtcgatgggaaggcccaccgtcacctctgcggcggcggtcagacggcaggggcacagattcccctctttctccgtcagcgtgacatcggcgctgatccccatctcacggaatacagaccggaacacaaaagcgcccagattgccggggacaatcacaatatgctgcccatcctccagatacggggcgatccggcgggcgatctcctcgtggcggtccgccattacatggacgaaaatagcctgcgctttatggacggcctgcgcgggatcggtggtcaggcaggcgggcatgaaagttccgtgcgcctccccgcgcagcgtaatcccgcccagccgggagatatcctcaaaacgggatgaaaaacggctgtcgtcgtgggatgtgaccgtgaacccgcgctgcgtcagatatgccgctgcgctgtgccctgtcgaacccgcgccaatcacagtaatccgttgtaccatggaaacaacctcctgaatttatatggaaatacattgctccaaccctttgcaattcatattgtacgcgtaacgttccggccttgtccaacggggttttacggtacggggtatcggaagttttgaatccgcgccgaacccatccatcactctttttcctatcccataccgagatgctgcgttggacagcagacgtgttttgatgtaggttaaaagaggaacaatgggaaaaattccgcaattttccggcaaaaaggaggagccctatggtacactacgcaatagttggatttggaaatgcgggttatcatgcagcgcgcgctattcgtgcgcgcgatccccagggagaaatccatatattgagcgatcaaacttttccgcccgccaatccgatgctgaccacatattacgtaaaaggggcgctggattggccgggtttgtttccgtatggcagcctggaggagctgtcccgcagcatgaagctgcacctgcacatggggcgacgggtccgtagggtacatcctgtgcagcgggaactggagcttgccggcggcgagcgaatcgaatatgggcagtgccttatctgtacaggcgcttccgcctttctgccgccggctgaagggatggatcttgcaaacgtctgttgtgtgcgtgccccgcaggacgctcgccgcctgaagaatgcgctggaaacacagcggctccgttccatattggtggttggcgcttcgatggtgggaatcaaggttgtggaattggccgaccagtatgggattgcctgtacccttgcagacggcgcacctcatttgtttgcgctggccgcttttcaggacacggctgaacggattgagcgttatttaaaaagcaggggcatatcacttgctttttccgccatgctggataaaatcgtccaatctccaaaggcgccgtccggtgtgctgaccgcaatcatgaaggatgggcgtcagcttccagcggatttgatcgtggtgtgtatcggcgccagagccaacatggaactggtgcgcggcacgccagtggtgacgggccgcggcatcctggtggatcgggggatgcgtacaaacgtccccggcttgtatgcggcgggggattgttgcgaggggtacgagcttcaatccaaagaacagagaaacatcggcctgtgggcaaatgcgggctatcagggccgtacagccggcgcgaatatggcgggtgcggatgagtcgttcgactatacgatcctgcacaacatcagccactttatgggcattgattttttgggcatgggggatatcgtccatccgcagccgggagaccgataccgccgttggcagcgcgggacgctttatatccaggcgatggaaggtgcggacggcacgctcaaggggcttaacctcctgggcggggcggctgtaagcggaatcgttaaaaaccactttatgaagcggctgtccgctgaaaatgtgcaattggacgcgctgtcgcgctgccaattgaaaaacgccggatttccccaaaactttattgattatctcggaggtatggtatatgacggagcttgagagaaaaattaaggcaaaaatccccggcgccgacactgggatcgaggtcaaaaaaagcctgtgtgccatctgttctcccggcaatcactgcggccttgacgtttatgtaaaggacggcaaaattttaaaagtagagggtacgccggagcatccctacaatcagggacatatctgcacgaaaggagctatgaacagggcctatatttatcgtaaggatcggattcgcacgccgctgcgccgggtgggcaaacgtggcgaagggaaatttgaaccgatcacctgggaagaagcttacgcagagattgcggagaagctcaaccgtgtcaaggacgactatggcgcgaactccgtcgcttttaccaccggatattgcaagtggtatcgtccttattatcaccgctttgtatacgcctttggttccgtcaattattctaccgatgactgtacctgctatcgcgccatggtgctggccaacgaatgcaccatgtgccgggctcagggccctgatattgcccatacgaatacattgatggcctgggcatggggcggcttttattctgaccatttgagcgtgggcgaggtggaggaactgaaggcgcggggcggcaagatcgttgtcattgattcccgaatcaccagggccagtcaacggtttgctgatgtattcctgcatatccgtcccgggacggatggggcgttggcacttgggatggctaaaatcattttggacaacgggtgggccgatatggactttatccggcgttatacttacggttttgaggagtatgcagcgtatgtaaagcagtttgatctggagcgtgtggcccgaatcaccggcctgaacctggcggatatcatggaggccacccgcctgtttgccacgaacggaccggcctgctgcaacttttccgcctccacactgacgcagcagtataatgggtttcagacacaccgcgccattctctgcctgcttggtctgacgggaaacatagaccggcccggaggcaatattccctccagcaatacatatttgtgcaggcccgccggttttaaaagccgtaaatcacaatactatatggaaaaggcgcccggcaggaccatgcccacattgatgatatatacgatgggagatatgctggattgggaggattgttccggcaccgggcactcttcggccggtgtgattcccacggccgtgattgcggcggaggttcttaaaaagagcggtaaagacttgttcactgcggtagtcgccgagtacgaggtgtaccagcgtgtggcgctcgcgggcgataccaatatcgtaggtttcaatatttttgcctgcctgttttgatgaaactgctcgatttgtcggaggagcagatgaatcaggcgtttggcatctgggcggcctgctcaattatcccttggcgggcctggaggccccgttacggtctggggtgatgggacacgcatggcggcgccgcatgctgcgctgatactggggacattggccgatgcgctggcctgggaggattgttcccccaccggccagccttccacgtgcgctgttccctgcgcatggctggcggctgaggaacgccataaaagcggccggaaactgatcgccgccattatagcggcctatgaagtttaccagcgcatagccctggcagtccagccttcagagggacgctggcgggaaaagggatgggggatgcagaattggcagatttttgcggcgatcatccctatcgccaagctgtacggcctggacacgcggaagattaaccaggccatcggtatgggctgtgaatgcagcgtcataccaacaaatttcgccgctgccaccatgtcggatttctctcactatgaatatggctatcggggcagggacggctttttgattgccaaagcggttgaaaagggaatttacaaccagcgcgacgcattggacgatccccgctgctatacagggattgtatgcggtgatgagagcgccaacggcgacgatgaaacaaaaatccatgccgatgaatcggaccgcggttggctgaccagggagcttgggacacgctgcctcatccttgaaacgatgctgcgcagatggcctgccggtatctgggcgcagtcaagcgccgagttagcccatatgctccagcaaaagtatgcgttttccccggagcaagtggaggaaatccttgtcgatcccccggtcgaggggtatatggatattccgcgggaagagttaattttggatatccacgcccagaacgcaattccgtttgttgttgcgtctgtcttgacagatcccgtccccggcgcccattggtattcatccggccggatgcgtgatacaaaactgctggccctggcgcaacgggtaaagccgggtccctcccaagcgcaatccgtcatctcaaactatcaatgctttcaaaaaggcagctatccaaaccagcggatgattatcaaactcaaggatgggacgccgtatcaggctgagacggattgcccgcgcgggcatccaggcaatatgccggatatgcaggaacaaatcaagtctttccaccatcaggcgaagggcgttttgccagaagaaaagatctgccggctcacagaggcaatttgcactctggaggactgccgggatatcgcggaaatcagcgcgctgctcagtccgcaaaacaaaaaataaaaacaaaggaggcatgcggtgaaaccgcatgtctcctttgtaacttgggagcgtattttatcagccatgctgcttttgccgcttaaaccatttgacgacctctatctgaagaacagaggagagagacagcatgagcacagctatccattggacgctgcttaagccagtcagcttgaaggcgctttgcggggacggcaacagcaaaatacaggccatcaaagccgcagaaactaaaaaggaaagaaccagccacgggttgataccctcggcgcggacccaaatcggttccgtattggaccgctgattaaaagcgcgcagcatttgagagaacgccaaaacgcagaaggccatcgtctggcctgtggttggattgtccatgcgcgcgccgatccaataggcgagcgttgtcatggccgccacgaaaataccctgcgtgatcacacggcataccagatccttttcaaacagcgtaccggatttcaccggcggatgcttcatgatgtttttacttgcagggtcgacgccgagcgccaatgcaggcagggtcgccgtagcaaggttgacccatagaatatggacggcaagcagaggcgcttcccagttgaatatggtcgctgcaaacagggtcgtgatctccgcgatgttgcctgccagcaaaaattggataaccttttggatgttgcggtatacccgccggccctccttgatggcataggcgatcgtcgtaaagctgtcgtccagtaagatcatatcggcggcgtcctttgccacgtccgtgccggtgatccccatggctacgccgatgtccgcggccttgagcgcaggggagtcattcacgccgtcgccggtcatggccgccacctcgccggtgcgccgcaggctttggatgatccgcagcttgtcggcaggggacacgcgcgcgaatacagtcgcgtttttgacagccgcgtccaaagctgcgtcctccagttcatccagctcatcgccggagatcaccgtgtctccaggccggtaaatgtccaattcccgagcaatggcaagcgcagtaaccttgtgatcgccggtgatcatgatcgtgcggataccggcctggcggcatgtgcgtacagaatcagcaacctctttcctgggcggatcgatcatgcccgttactccgaggaaggtcatatcgtattccacattgtcgccgtcctcctccggaatctgttcgccggtcagggtacgcgtggcaaagcccagcacgcgcaaagcctgctccgacatggacaggcaaaggcgcagaatgtttgcacggtcgcctcctgtgatggggcggactccatcagccgtcaatatatgggtgcacagcggcagcatttcatctacggcgccttttgtataggaaatccagtttccagagatcacatgtactgtcgtcatacgtttgcggtcggaatcgaacggctgctcaaaccggcggggatatgtgtcctccagggcctcatgatcgactccgaaagcctgagccatgtgaatcagcgcgccctctgtcggatcgccgatgattgcgcctgcgtgatccgggtcgacgctcgcatcattgcacagcgccgccgcgtaaacaagctccttataaacaatggggtgctgtccggtggcttcggcgatgggggtggtcgcgcccgcttcaaaatcgccgtttaccgcgatgtgagtcacagtcatctgattgagcgtcagcgtccctgtcttatcgctgcaaatgacagtggcgctgccaagcgtttccacagcgggcaaattgcgtacaagcgcattgcgtttagccatgcgctgcacgcccagggccattacaatggtcgccgtagctggcagaccttccggaatgatggaaattgccagggaaatagcaacgagaaactgcgggatcagtggacgctgatagagcgcgccgatcaaaaagatcattacacagacaatcagaccgacaatggtgagcgttttaccaactgcattcagcttgcgtttaagcggtgtgtcaagctcatcctgctcctccagcatttcagcaatgccgccgacctgcgtattcatgccggttgccaccacaatgccggtcgcacggccgtaggtgacaatagaggacgtatacaccatattgctccggtcgcccaacgggcaatccagcgggagcaaatcgtcggcgtccttttcagaggggacggattctccggtcagggaggcttcctgcacctttaagttcgccgagtcaatcagacgcatgtcggcgggcaccatatccccatcgcttagaaatacgatatcgccggcaaccacctcgctggcggggattatgctttcgtcgccctgccgcagcacgcgggcggtgggtgcgctcatattgcgcagcgcctccaatgaggactgggcctttttctcctgcacaataccgatgactgcattgagcgccacaatcgcaaagatgacgcccgcttccgtccattcccgcagcacagcggagcatacggctgcgccgacgagaataagcaccatcggatcgataagctgtgaataaagcatctgcaaaatggttttgggcggtttcgagcgcagctcattgtgcccatctttttttagccgttcggcagcctcggcatcgctgagcccctcgctggaggttcgcaaagcttcgtatacttcctgtactggctgacaatgccaaggcgtccgtctgtgatcatccataaaggatcaatcactcctttcaaaatatatctctgaccgctttcagactgacagatacctgtttcacacgttttttcccaatatgatgtgcggtaccaaacagacttttcagcggatgcaggcaataggggcatcgcaatatgtatgcaatgcaaaaaagacataacccgcaaacccttataaaaaggtgcaggttatgccttttataaaaatctgaataaaatggctgcttcgatcagcgtcgctgctatcggcgtcgtccatacaagcggatggtttcctctttctgatgtatttgctccattatatgggaaggcggcacaaatgtcaataggcaagagggcgagataaaaccgttttatatgtcaaatgcatatctgacaataaaataaaagcattggacatttgaagcaatgcggtttaaactggaaatggatcattggtaaatggatactaaggatccagacaagacaagaaagggaggagatcgtgtgtcccaagcgatgaacgacatcaaaaaactggggtttggattgatgcgtctgccgcagaaagatggcaagattgatatcgtacaggtcaagcagatggtggatcggtttctggcagagggatttacctattttgatactgcatgggcgtatgcgggcagcgaggatgcgattaggcaagccctggtggaacgctatccacgggaccgctttttgctggcgaccaaaaatgcggcgtggatcgattgcaaatgccgggaggatgcgattaagcagttcgacatttcccttcggcagacaggggctggatacttcgacttttatctgcttcataacctcggagaaagccgaacgcatttctttgatgattttgatctgtggaactggattcaggaaaaaaagcggcaagggttgattcgtcatgccggtttctccttccattccacaccggaggagctcgacgcgcttctgaccgcacatccggagatggaatttgtacagcttcagatcaattatgctgattgggataaccctgccatccaatcgcgccgctgctatgaagtcgcgcgaaagcacggaaaaccggtaatcgtcatggagccggtcaagggcggtatgctggcgacgccgccggcgccggtagagcagattttaaaagcgtctgatccgcaggcgtcaaacgcatcttgggcgattcgctttgcagccgatctcaacggcgtcatcacagtgctgtcgggtatgagcagcctggagcagatggaggataatcttgcaagtatgaagcgattttccgggcttaccaccgtccagaaacaaaccatcgtgcaggcgcaggaggcgctggctgaaattcctttgattccatgcacaaactgcaactactgtgcaaaggtatgtccaaaaaacattggcatttcaggttccttcacagcgatgaactatctgacactctattcgtccagggagatggcggtcaatcaggagaattggctggtcgggcggcatgggaaaaaccgtgcgaatgaatgcatcaagtgcggcaaatgtgaacaggcctgtccgcagcatatccatatccgcgatgaattggagcaggtcagcaaggctttgctggaatagatgcagggacactcaaacagctcctaattgtaagacggcggcaagcgcatcgcgcttgccgccgtcttagctcatccgccgcagcgaagatttggacgctgcggcctgaatgaatgaaaatccttgtgcatacacatactcaggagggatccgtatgtatagggtatttgcttttaagcgcgccttgatgggcattttatgtctgctgatcgccgcgctgatcctgcttggcacagcggtaaatattatgccggtcggtgcgccgcagcgcgcgctgccgatctattccgttgaaacggaaaagccgcttgtttcgcttggaattaactgcgcgtgggatgacagcgatatcgaccgtctgctggagctgcttgaccggcacagcgtgaaagcgacgtttttctttgtcggcgattggtgcgacagatatcccgatgcggtcaaaagaattgctgccgcaggacacgagcttggcagtcactccgacacgcatcccgatatgacgaagctttcacgtgaacagatcgaacaacagcttacgcgctccggggataagatcgaggcgttgaccggcgtgcggccggctttgttccgcgcgccgtccggcgcatatgacgatgaggtcgtacagaccgcacgggcgcttggctgggaggtcatccaatggtcgaatgacagtttggactggaaggggctgagtgcgcaggaaatttccgcgcgcgtcattaaacaggcagcgcccggtgatattatgctgtttcatgctggaaaaccgaatacagccgccgcgttggatacggtcctgacagagttgacagcgcgcggataccggtttgtgccagtgggggaattaatctatccggcgccgtacacaatagaccataccggaagacagtttgcaggcggataaacgcacttaaaaatggctgtttgcagatgttttctatacatctgcccgctctgcgggcaggcgtattttaatcaaacggccccgcgccgcaggcggcgcagatagctgatttttttataaattgcgctatgcaatccataaaaaatcagcgcgggggatagatacccttggaaaggtggtgacggtatgacgattgtaactgtcggcggcggatgggcaggctgcgcggccgcgcttggcgctgcaaaagccggcgtgcgctccgtgctgcttgaacggacggatcaactgcttggcacggggcttgtgggcggaattatgcgcaacaacgggcgctttgcagctgccgaggaattgattgcgatggggggcggcgcattgttttcacttgcagatgaaaatgcgcgccacacgaatatttcctttccagggcacgtacatgcgtccctgtacgatgtgatccgtatgccggctctggtacagcgccttttggaggaagcgggagtagaaatttatttctgcgcgcgtgtcacggctgcgcaaatggatggcacgcgaattatatctgtcagtacacaggatggccagacattgagtggcgaccagttcatcgatgcaaccggaacagccggcccgatggccaattgcactaaatatgggaatggatgtgcgatgtgtgtgctgcgctgcccatcgtttggcggacgtgtcagcttgacggcgcttgcgggcgtacaggagctttgcgccgaacatgccggcgcgccgtctggggcgatgagcggctcgtgcaaactgctcaaggaatcgctttcccccgagcttgcaaaacggcttgaccgggaaggcgtcgccatcgtttcgatcccggctgaaatggcagccgatcggctggcgctcaaggcgtgccagcagtatgcgctgccccagttcaaaaacagccttattctgcttgatacaggcggcatcaagttgatgtctccatatttcggcctgcgctgcctgcatatgcttccaggctttgaaaacgcgcgctacatcgatccatgcgccggtggccgcggaaactccatgcgcttttttgctatggctgtgcgcgacgacgctatgcatgtaaccggtgtggaaaatctgttctgtgctggagagaaggcagggctgtttgtcgggcatacagaggcgatcgtcacagggacgttggctggatataatgccgcgctggcagcgtgcggacaagagccgcgcgtttatccgcgcggcctggccgttggagaggcaatcgcgtggacgcgcgaacagatggcgcagcccaaaggacttgaaaagcggtataccttttccggtgcgtcgcttttggagcatctcagggaatgcggacttgacagcgacgatcgggatacgattcaaaagcgcgtgcgtctggccggcgcccaggacctatttgcacatatatgaccgcgattgaaaaaaccggagcatgccttaaaaaaggatgttccggcttttgccatgtaaaatcataacaaaatggctatgtgccgcctttagcggcacggcctgaaatcaaagcgcgtggaccgggacatctcatatgcgtaaaaactttatgcgccgtcagttatgcctgcgatcgtggcgcatccgcagcgcgtgaagcattatactgggaaataaagggacaataccgtttgttcaagctcttttgaacatgcggccaatacggcgcttttttcaccgacaggcagcggcatgccgtgcagactgcaaatggagccgcccgcttcgcagaggatgatacgggctgcgttgtgatcccacggtgaggaacgcggcgcaatgaacaggtcttcttcgcccgccgccacggcgcacagctccagcgccaccgaaccgagactgcggattccccgtacatcctgtgccaattggattataccgtcctgatgaggatggggttttaaaaatgtatatacaatatctggaacagagagcaggaggtcagaaatatttgagcggccggatacatggatagccgtttcatcgcgccaagcgccatggccggcccgggcggaatagagcgtttgacgctccgcatcgagcaccaggccgaataaaggtgtcgtatcctgccagcagccgacagaaaccgcgtaactgcggtgcgcgttgataaaattggtcgtgccgtcgatcgggtccaggtaccaggtgacattgccgttctggccggctgcgggaaactcctcgcctataatggagtcatgaggaaaggcggagaggatcgctctgcgaagaaaacgctctgtttcggcatcccatttggtcaccaggtcctgatgtcctgtcttttggtgaacgtcgccaaattcaaaatgaatccgacggagcatatctcccgcctgaagtacaagtgtgcgcgccaattcaaaacgttccatatccagccttctttctttgcaatactaggggctgtttgaaaaattaaaattcccgtcatttactaaaaacagcgacggatgatgtgttaaaagccttgaaatccgaaaagattcctgtgatttttgccctccattttcctactgcttgcgaaaaatccggcaattcctctattttcaaactggctctgacagtgtaaacagctttttgcggtacgcgcggcagagaagccgtctcaccagagcacctccaatttgctgttttggaaggatggtacagggctgtgcgcacgcaggtagcgggccaccaggtcaggcatttcgacgctgccccgccagagcaccggacaggcgcgcagtatctcgtagccgccggttccggttgcccggtaattgctggtgcacagacgcaggggtctgtcgccgagcggggaaccatccagcctggtcagatgtacaacccggtcgccgatcggccggcgcaaatcaaacgcgtaagaaatacctgcgtaaaaatcatagttatagtgctcgatttttggcatcaaaaattcgtcagatacgcgcggccgtccgtcctccaatgtgaaataagcggcgcaccgctcaagggcagctttgatgacaggcgcggtcacctccagtacaaccagcgtattggcgaacagataagcggctgtcactccgcgcatggtgacaggtgtaaccagtccgacagggtcgtttccaaggctggtgcaggacaaatccgctccggttgcctctaactggacctgattaaacagagatgccacctgactaccgtatagcgccgccgacagcttttcctcaggagcgataggctgtataagcgtcccgataggcagatccaaccaacgttgcacagattcctccaacgggagcagcgattggaagggatgctcggaatgcctgttccccactgggagcagacgagatgaaaaatgaacggttggttcgtcaaagtgcccggtgatacgcgcataccggctggcgttggcaggcggctgtacggcaaacgtaccggcaatgacggtctgttccacagccatatgctgatggccggtgagcaacaggtcgaaatcaagctcgcgggcaattttacaggcgatattttccccgctgtccgacaaaagccgtccgctctccagttcctcctcgaagccgccgtgatagatgcacacacatacatcgcagatccccttcagacgggccagagctgtccgggccgcctgaaacgcgtcggtgacgcgcacccgctcaagattctgcggctgctcccatacgttcacaaaatcggtaaccacgccggtgacgcccacacgcaggccattggcgagcgtatggacagcatccttttggagcggcagtccgccgtccaaatcctccacgttggcgcagagacaaacgccgtccatggcgttgagatactctctgagaacgtcgtagccaaaattgaaatcgtgatttccaagggtgaaatagtctacgcccacagcattaaaggctgcggcggcgggatgaatcggccaatgctcccgatgctccagataatactgtgtaaggggcgtaccttggagagaatcgccgccatccaaaacgagggtattttcgtccttttgaatttgcgcggccagatttaaaagcccggaatcctcataatggttcgcggcatagttgacgggaaatatgtggccgtgtgtatccgaggtaaaacagatggtgaacgtctgaagcatatttacccccttgccagcttcactctgatttttgtggaaatccattccacaatcagaacgagcacaatcaaccctgccaggattgcgcccgcttcattccagcggtaagcgttcatggcgaatattagcggcgcgccgataccgcccgcaccgaccaggccgagaactgttgcgtcgcgcagattgatatcaaaacggtagatagctgtggaagcgaaattgggcatcaattgcggcaaaataccataccggattttctgccaggtggtgcagcccgccgcatccagagattccagcacccgcacatccaaatcctcgatggcctcgatatacattttgctgaccatacctacggaacacagggacatggtcagcaatccggcgaatgcgcctggtcccgtaacccgaatgaacatcaaaccgtaaacgaaggcgggaactgtgcgcaccgccatgatgatgattcgtccgataaaggctaccggccgtggcgtcagattggatgctgaaagaaatgccagcgggatggagataatagcgccgacgatcgtacccaaaaaagcgatgcagatggtttccatcagcagatacggcacgccctgcaccgttagattgaacagcagtccggtatcgggatgaaaaattccggaaaggatgttcagtgcaatcttggcgccgttttgtgttgtcccgctcgtttccacagcggagccgctccaaatcagaagccctgtgacaaccgccgccacagccagctcaaagatataccgccggggccgctgtgcatagatctgttcaatacgttgattcatacgccccgcctcctcaaacaagccgcctgcgcgcggcacggctgatggtttcgatgataaatacagtgacaaacagtgccaaaaggatcattccgacgctagaatattcccgccagccgatcttttcattaaggatcagtccaagtccgcccgcgccgacatagcccaaaatggaggcatagcgcacattgccttcgaaacagaacaggcagttggaaagataggagggcaatacctggggaacgattgagctgataaaggcacgtaccttggtggcgcccatagcttccattgcctcaaatgcccccatatccaccgtctcgatttcctcataaagaatttttccgatataggcgaaggtgaaaattgcgatggctgttgtccctgctaaagtgccaagaccaaaaacataggtggcaatcagagcggaaacaagcgttggaagggtgcggatgatactcagcagcagacgcatcgctccaacgacaatccggttatggatgatattggtggacgccagcatggcaaagggaacgaccagaatcgctccgatggccgaacccaaaagggacatcttgatggtgtcaaacaagggctgccatatctggggcatataattccattggggtgggatcatatcgcccaagattacaaaaaattccctgatgcggctgatcagcaccgtgaggctgaagcctgtgacccgaaccgacagcgccgtcatcgccaacaggatcagcacggcgaaaggcgctctggaacggcgtttacaaatctgcttcccattgggaagcgtaaacactctgggtgtgaacagcttatcataaaggttcatacgcgctcctcccgcctgctttgatatatggcgtccagcacggcctcatccacctgactagcaggtccatcataaacgatctcaccggaacggatgcccaccacgcggctggcgtactgcaaagccagctccacatggtgaatgttgatcaggacggtaatcttcatctcctgattgatgcgcagaaaatcgtccattacctgcttggctgtcaccgggtccagcgaggccaccggctcgtctgccagaatgatctgtggattctgagccagggtacgcgcgagcgccacgcgctgctgctgtcctccggagagctgatctgcccggacaaacgctttgtccaggatgccaactttgtccagcgcctccagggccttgatcttttcttccttggtaaagataccaaacgcagcccgccaccagggcagatcgggtacaaacgcggtgagcacgtttttgataaccgtcgtccgggtgatcagattaaaggattgaaaaatcataccgatgcggcggcgaaacgcccgcaggctctttccgtgtagccccatcacatcggttccatccacgttaagcatcccttcagtaatatcatgcatccggttgatggtgcggatcagcgtcgatttgcctgcgcctgacaatccgatgatggctacaaattccccctgcccgatggtcagactgacattcttgagcgcctcaaagccgttgggatatcgcttgcttacctgcctgaattctatcatcttgttacctctccattccaaaagagggaggaaagccatccggcatatcctccctcttttcggtacatttttcagtgccggattcagccggcgctgttgagcgaacgtatcatttcctgcgcggcccgctcggaatcatagtcggacgactcggccggcatatagccgttgtggctgtagatggcgatgacctgcttgccctgttcggtattgccgatattgataaacgcttcggacaaagctgccttgaagctgtcgtccataataggggaggtcttactgacgctgatcgtatcgttataaatggcgggcgtaacgccgatgacggccgtatcaccccaaatgctgttggtcatggcatactcgccggtccattcgtcctcataatcgcggcggccgtcggcatatgtacacaacacatcgacctggccggaggccaggcgcgcaaaggcgctgccgtaggagtcagactgtacggcgtggggcaaatcagtgatgtttttgctgaaattttcctgaagccacagggatggatagatatatccagcgggggaggacgagttcataacgctccagttcgcaccgcttacatcctcccaggtcagttgctcgccggcgttgactttggccgccaacgccttgcctttttcggaaggtccggcgatcatcagggcgcggtagctggtgacctgatcggttgtaggctgtgtcggggcgttgtcgttccaatccttggcgctgtcagagtcgatggacaaaccgtcgcgtgtggcggtcagcagcacatcacatccgtcatcatacagcacataggtgccgccggggataaggcccacatcggctgtgccggcggaaagggcctctcccacggcttcatagctggtgcccactgtgatatccaccttgcccacgtcatagccgagcttggccagttcgtcggtgagcatctgcttgagcggttccgtggcggtgatgatttcatccggctcgcgtgatgggacaaaagcgatgcgcagcgtatcgatagctttgttgccggcttgcgcctgactggctgagactgcgcctgcggattccggcgtgctctccgcggtgctctgcggctgtccgccctgtccgcagccggccagcagaccaatgctcatagctcctgccagcaggaaagtaagtccctttttcataattgtttcctcctgattttgaatcgttttgattgcctgcatttatcttgcaagaatccgatgcgcacccggttccttgaaaaaattcagggaggggacgaacggaatctaagggaaacgccttttgcgggctgtctacgcggtatcgccaattttcagatgggtggggattgtaacaatgaccgcctgagcgcggcgatggctgatcctgccgaataaaagctccagcgcgttttcccagacgtaatcgggaaacatctccaggcatgtccctgtgggccatttgctttcaagcgtttgaatatcctgatagatgataacagctacatccttggggacacgaagccctgtctcacgaaaggcctccagtgcgccctccgcgacctcgtcgctgccgatcagcatagcctcggccaacgcgcccttcgcaatagcatttttggccatatggtatccgctttcccggctgatctcaccgatatgaaacaacgcgggattgtactggagacgctgctcaaggatacgtttgagagcggccaggcggtgcgtgccgatgcttccattttccccgttgtagattccgccgatgtagccgatgtctgtataccgcttttgatccagcagataagccacagcgtcctccagaccccggtcgaaatcaacctggacctgatcaaattcatagttgtgctgatccgagttgacaaagacgatggaaaaagtcaatgtacgcaaaaaatcaatctctgttttgctgaacgcgccaaaggcaatgataccgtctaccgcctgcggctggttgaaggaaagacgcacgaaaatgacatcgtattgatccgacatcatctgtacaagacaggacaaagatgagagccggacattatgcctgtcaggccggatgattcgccagtccgccaccccgatcaccaaacgccgcttatgctctgcggcccgtcgctgccttggggaaacatatcccagagcgtgagcggcctgaaagatacgtgcgcgcacctgaggagaaacgcagatttgctcgtccttattcaaaacccgggagacggtggcggcagacacctgggctgcttgtgccacatctttgattgttgccataacgcgccgcctctctttccgcttgaattttagaacctgtattcacagtcgccaaacgccgtcccggcgggcctttttccctgattggtacagcttctgaatatttttgccgaacgacagcctgcctgcaaaaatttgccttgagcgcatacaaaacgccgctcctgtccagcatccttcggctgtgaatacaggttctgatttctttctgattttgattatatcgcagtccagtgacaagtcaatataatttactaaatttttactaaatatttgacaggatatgacgctgtaccggttaaagcccccatttttcgacaatagcataatagagcgtgtcggcacgcatgtggaaccaccgccttttggcagaatttccgccctgtgtcgttaaaaattcttgcattccaccaaaggagtgcggcaaatttttgcctggcaggacaaaaattctgctcaaaatgcgttaatttcaacttatgtcaacatgttccggcacggagcttttttgaaacgaaaaacctattcataaaaattgctgcttcagacaagccggcatccaaaaagacaggaaccgaaacggccgtttttttgtatgatggaaaggcggctttcttatcgcgctgcggttgcagtgtgtgaagcgcaaaccatgaaaaggagattccattatggcgccttataaaattcaggtatgcggcgtgagcaaatgctttcgccgggacggcgcggaggtgcaggccatgcggccgaccagtctcaatatcgaggaaggtaaatttatcagtattatcggaccgagcggctgcggaaaatcgacgctttttaatatcattgcgggtctgactttgccgaccgaaggcgatgtgctggccgacgggcaaagtatcgtaggccggtccggatatgtcggctatatgctgcaaaaggacctgctgctgccgtggcgcagcatcctagacaacatcatcctcggtatggaggtacgcggtgtaccgcgcacacaggcggtggccaaggccatgccgctgatagaaaaatacggactcaagggatttgacggccatcatccaagcgaattgtccggcggtatgcgtcagcgcgccgcgctgctgcgcacgcttttgtacgaccgggatgtactgttgcttgacgagccgtttggcgcgcttgacgcgcagacgcgtttgtccatgcaaaattggttgttgcagatctggagcgactttaaaaagacggtactgtttgtgacgcatgacatcgatgaagcgatctatctctcggacgacatctatgtgttttcaccacgtcccggctatatcaaggagaagattacggttgacctgccgcgtccgcgcacgcccgcgatgatgacatcggaaccctttatgcagctcaagcatcggctgttggatcttttggcgcagccggctgaggaaatggaccaactttgtgaagaacggggtgagaaagatggaagcgactgaaaaagcggaccggacggggctgacgcgccgccgggaaccagacatagaaacgccttgtgtacacaccgccgcgaggcggattgcttcagagctgcatcctggcaggcgcagccggatcatacgggcgggccgcgccgccgttgcggtgctgctgctatttatatgggaggtttttacacggatcggctggctggacccgtattattggagccgtcccagcaccattcttaaaacagcggctgtacagctttcacaggggacgctgctgatggatatcgcttatacgtcaggctctacgatcttgggctttgtgctcggcacggtgatcggctcggcgctcgggctaaccttttggtggtcaaaaacatatgccggaatcagcgagccatatctgattgttttaaacgctctgccaaagcttgcgcttgcgccggtgcttgtcatactgtttggaatcggatttccgtccaaggtgatcttagccttttcgatgactgtcatcgtatcagcactttccgcctacagcggcgtgaaaagtgtcgatccggcgatggagacactgctttactccctgggggccaaccgctggcaggtgttttccaaagtggtggtgccctggtcgatgccgtggatggtcagcagtctgcgtgtcaacatcgcattggcgctggcgggggcaattgtaggcgaatttattgcgtcgagccacggcgttgggcgcatggtcatctatgcggggacgattttggatatcaacctcgtctgggtgggcgttatggtactttcgattctctcgatggcgatgtattggggtgtgatccttctggaaaaaagtctttctaaacgtctttcaatcattcaatcataaagcttaggaggaacagtatgaaacgatttcatctcaaacacacaggcaggggcctgctggctgtcctgacaggcgcagcgatcgcgctgctgcccggctgcggcgcggccggttccgcggacgcgcagatgcaaacacaaaagctggtgattgccgagccggtacacctgatcggttatctgccgctgtatgtcgcacagcacgagggatacttcgccgaacaggggcttgaagtggaggtgatccaggcgacgggaggcgcgcatgtcacggcggtcatcagcggcgatgcatggggcgtgatcgggggcgtcgattccaatgcgcttggcagcaaaaacagctccgacccgatcgtcggcgtatgcaatgtggtcaaccgcgcgaacgtgtacctggtagccaggcagggacttgcgccgtccggaaacagcgacgaagatctgcgtgaatttttgcgtggaaaacgcgttgtagcgggccgtcacggcggctcgccgaacctgcttacccgttatctgctcatcaagctcgggcttgatccggatcgcgatgtccagatgcttgagccggccgatgcggcgactgtggttgcgatgctgcagcaggatgccggcgatattggaaacggcggcgagccgcagatcagcgaaggtatctcggccggtgtttggggcgaaccgttttataagttcccggatcttggggatttttcctattctgtcatcggcgtgaaacgttccacaatcgaaaaggaccctgaaacggttcagaaattcaccaacgcaatgctcaaggcgctgaaagcggtgcaggaggatcggccgctcgccgaacgcatccttaaaattgagtttccgacgctcagcgacgaggcgctcaaggcttcgcttgaccgtgcgtatgctgatgacctgtggagtccggacggtttcatttcacgtcaggcggtcgacacagatatggatgtattgatccaatcaaaggtttatgaggggacgtatgactatgatgaactggtcgatatgcagttcgtcgaagcggcacagccgtaacgaaaataccgggagtacaggcagggcacactgtaagcgcggttaaatctgggatttaacaggtgtgaaggctggaaaataaattggaaatttcctattgacaacgcatattacaactggtataatattgccatcggcacaaaataaattctgagggaacggaggggactgctatgacagcgattatgtatatcaggcaaaacagttttggactgcgcaatgatgctcattgttgcgggcttcttgtgatgcaggattcggtttgtatatccatgcgctgtaagggcagacccccaaaaacccggatgacgggctgattgtgtccccttgtatatacttcgcattttggaaacaccggccgcggcatcactgtccgcgtccggtgtttttgtttttgcatattttctgccctgtagagacagccggtataaccaatagacgcctgtacatgagcttggctttcacctggattggtgagggcttggttggttatattatatacaaatagtaatattgtgataaaagccggccagtcagggaattggttggtgaatgatgatgaaggaaaaggagggcagccgccctatgttggaggttaaaggaaaatacaacagcgcaaagatttttaccgatgtggttgacaaagcatcggtcgcgcaggtgattgagctgtgcaaccagccttttacagccaaaagccgcatccgcatgatgcccgatattcatgcgggcgcggggtgcactgtcgggacaaccatgacgattaccgacaaggtcgtgccaaatcttgtgggtgtcgacattggatgtgggatggaaacggtgcatctgcgggaacaacatttggagcttcaaaagctcgataaactgattagagcgaaaattccatcgggattttctatccgcgaaaaggcgcaccgttattttgatgaaatcgacctgacggagctttactgttaccgccagatcaacccgctgcgtgcggagaaaagccttgggacgctcggtggtggcaatcattttattgaggtggaccgcgatgatgaaggcggcttgtatcttgtgatccattcaggcagccggcacttggggctggaggttgcggcctggtatcagaacgaggcttaccaaaggctcaataaaagcagcaaatccgatgaggccgccctaatcgcaaagcttaaatcagaggggcgcgataaggaaattcaaaaggcgatcaggaagctgaaaaatacaaaacagacgtcgatcccaaagccgctggcctatgctgaaggtgagttgtttgaacagtatatccatgacatgcgaattatccagcgatttgctgtgctcaaccgccgtgcaatagccgacgatattctgaaggggatggggctgcacgcacaggatagttttacgacgattcacaattatattgataccgatgcaatggtactccgcaaaggagctgtttccgcaaaggctggcgaacgcctgctgatcccaatcaatatgcgcgacggcagcctgatctgtatcggacgcggcaatgaggattggaattgttccgcgccgcacggcgcgggcaggctgatgagccggtcacaggcaaaacaaagcttcacggtatcagagtttaagcatcaaatggatggaatttatacaacctctgtcggaaaagcgacgttggatgaatgcccgatggcttataagcgcatggaggatattgtgtccaatattggtgaaacggttcgtatcgaacggattatccgcccggtttataattttaaagcgggggaggaataaataaaaaagggaggacagttctaatctgtcctccttgtcttgtcaagcgcagcggtaaaatttgttatcaattataaaaataaagaaggatgcttgtttgtatttacaaatactagtataatatatgaaacagcaaacggagggatggaccgatgatcaaaatggttgccagcgacctcgatgggacgctcctgcaaaacggcgcgcaagctttaaagccgcctgtgttcgagctgatccgagatctgcgggaaaaaggaattttgtttgtagcagccagtggacggcaatatcccaatatgcggcgcatgttttctgaggtgtggaaagatattctgttcgtgtgcgaaagcggggcattggtgatgtcgcatgaccaagcgatttttacatctcctgtgccgcgtgcgctgtgcgatgcgatcatcagcaatattcttgagcatgagggctgcgaggtattgctttcaggggcggatacaagctattttacaggggattgccgggaatatgctgattttataacctatacgatgaaaaatacggttacagttgtggacgatctgttttcagtagaccgtgatatcctcaagatttcggcgtttgtccacaatggccgtgctgcaaagcttgttcccgcatttacagaacgctggggcgaccgtataagcgtggcgctttcgggcgctgaatggattgactttactatcgcgaacaagggcacagcaatccgcgtgctccaggaacgcttcggctttgcgcgcgatgaaatcatggcgtttggcgacaacttcaacgaccgcgaaatgcttgaggaggtcggccatccatatgtcatggaaaacgccgcgcctgacgtccgcgcgctttgcccgaatcactgccgccgcgtcgaggacgtgctggaggcgcttctccggtctttttgaaaaaagccttggaaaaaactttagccggctgcgctgcaaacagtggggcagtcgctttacaatacagcagccagagcggcagatgtttcaaaatagctgcctgtgccgcagcggcttttagtagcgcaaaaaaggcgaacacccatagggttgttcgccttttttaatttaacataaacggtaagcgtcaggcttgtttaataaaagaaaaactcaaaaattttgatttttcaaagaacccctaggaccgcgtattgagataacgcataatttcgccgccgattttgtcaagtgggaactgcttttggacagcgccgatattaaaagcgaccataggcattccataaacgacacagctttcctgatcctgaccgatcgtataggcgcctgctttgcgcattttcaaaagccccttggagccatctgcgcccatccccgtcaggataacgcccatcgcattgcgtcctgccgcctcggcaacggagttgaaaagcacgtcgacagccgggcagaaccccccgactttttcgctgccctcgctcttgacatagtagccgcgtgcatccttggccaaacggagctgaagaccacccgcgccgatgatgacctgccccggcacaacacggtcgttgttttcagcctccttgacgtgcatgcggcagatgcggtcaagcctctgtgcatacatatttgtaaagacagggggcatgtgctgtacgatcacaatgccgggtgttgtcgggggcagatcgcggatgacggccaaaatagcttcagtcccgccggtcgaagcgccgatggctataaccgtgttggtattgctgcgctgtgacgcgggcgaaagcgcgggcatggccggggcagtgtggacagatgtcgcggcagctggacgtgctggaacgcgccgcgtcggaattttggcggttgaagcgatcttgattttgacaatcaggtcgtcaataaaattattaaggtcctgtgacgatttgatctcgggctttttgacaaaatcaaccgcgcccgcttccagcgcgtcgagtgcgctgaccggtgctgaactgacaacaacgaccggaagcgggtggacaggcatcaatttttttagaaaatcaatgccgttgagcttgggcatttcaacgtcgagcgtaacgacatccggatttaattgtttgattttttccatggcgtcgaatgggtcgactgccataccgatgatttcaatccgtgaatccttggatagtccgcgttcaagtgatttccggaaaaaaagagaatcatcgacaatcaagagtttgatttttccgaagggcggcacctgtgtcatcctttccgttgataaattgcaggctgaatatacgcgtaagaggacgacggcccgctgctgatactttccgaatggccaataaacagatagccgccctttgccgtacagttataaaacttttgaacgagctgctgtttggtaggcgcgtcaaaatagatcataacattgcggcaaaaaattaaatccatcggcttgcggaatggaaacggttccatcaggttgagcggacggaaaatgacctcagcgcggatttgatcacaaacctgatactgtccattgggcagccgcttgaaatatttcgatacccactgcgatggaacatctttcagatcctcgacattgtagatgcctgcttttgcctttgtaagcacattcattgagatatcggtcgcgaggattcgtgtgtcccaattttttttgcgcgctccgaagtattcatcaagcaccatggcggtattgtaaggctcctgcccggttgaacagcccgcgctccaaatacgcagctcacggctgcgtgtcttttcgaaataagggaggacctgtgtacgcaaataatcaaagtgttccttttcacgcatgaaataggagagattggtggtcagcttattgagaagcgtgaccatctcagcaccggattcatcgcgaaacagaatatcaaagtagtcgctgaaatggttcagaccacggtggcgcaactcgtttgtgagacgcccttcgatcaatgtccgctttttagtgaggtcgatcccgtatttttttttgacaaagctggttagtttgacaaattcgtcgtctgtcatgcggataaggccggcttgcgtctgatccaagttcatgtgttaatggctccaatctgttgatttcaaagacgagctgtcaatagttcaggtcggccataaaaaacttttgacagtcgatattcatgatgatgcggcttccaaccttggcgatagaggttagatatttgtcagtcgcattcaagcccaattccggcggaggcgtgctgttctcaggggcgatgtccaaaacctccgcaaccctgtccacgatcagtcctacatgcatgtcatggatcatagtgacaatgatgcaggtcttttcgtcatacgcgcgctcctcctggttgaatttcaggcgaacgtcgatcaccggcacgaccttgccgcgcagattgataatacccttgatataggccggcagggcgggaaccggcgtgattggttgaatactgatgatttcaatcacatgtgaaagctctattccataaacaacgtcgccaatcaaaaaggtcaggctacggttgctcagttcatccaatgccgtgccggcgaccgtttctatggctgcatttgctgtactcatggcttatctcctttccttattcaggttgagcagggcgtttgcatccaaaatgaggctgatgcttccatctccgagaatggtgcagccggaaaggccgatttgcttgatcgcatatttattgagaaaagtcgggaacggcttgacaacgacctgctgttctccaagcagcttgtcagcaaacagacacgcggcgcttgtaccgttttcgatcagaatgacgattccgtcgcccaattcggtgatttgcgtttcgacatcgaacaggcggtgcaggcggatcaatgggaagcactcgccgcgcagcataatcatttccgtaccgtcggtattgtgcaggatctggctgttgtcatagatcttgaacgactgcgtaatagaggcgatcggcagggtgtagatggtgctgccaatctcaagctccataccatccacgattgcgagcgtgagcggaatcttgatgatgaaggtggtgcctttgtcgcgctcgctgtcgatggaaagcgtgccgccgaccttttcaatatttttgcgcacaacgtccataccgacgccgcgcccggaaaattcggtgacttccttattggtagaaaagcccggcaacataatcagaccaaaaatttccttttcggtgtattcggattcgggcttggtcagcaggccgttttcacgcgccttgcgcaaaagcacctccgggttgagcccggcgccgtcgtccgcgatggtgatgacgatttcgctgccgatatttttggcgatcatcgtgatgcgcccaatgtccggcttgcccttggcgcggcgttcctcgatcggctcgatgccgtgatccattgaattgcggatcatatgcataaacggatcgccgatggcctcgttgatggtcttgtcaacctccgtgtcgccgccctcagtgacaagctcgacctgtttatccagctttttgctcatgtcgcgcacaatgcggttcatcttctgaaacacgccggaaagcggcaccatacggatggacatgacgacatcctgtaattcgtcggtgagcttgtgcagctcgcgcgtcgatttgttaaaattgtccagacgcagccccttcaggtcaggattgctgacgaccatcgactctgttgtgaccagctcgccgacaagatccatcaactggtcgagcttggcctgattaacgctgacaaggctctgctttgttttgggcagcgcatcggacggcttgggcgcgctcgaagcagaaaccgccggcttcgcgggcgcggctgccggcttcgccgcggctgcgggcgccggggactgcggctcaggctcgtcgtgcagcaccgtataatttttaacgtttacggagctttcaatgacctggaaaatttcggacattggaacaagcggcttaaagatcatctcgaagccgtttttgataatctcagtacagcaggaggcgtcgttttcaggattggccgggatggttgtcagatcggcgcacagatccttaagctgggaaaccagcatgaatgcgcggatgttttccatctggcagtcatcgtcaaaaaagatccggatgcggcagatttcaccggcctgctcagcggcgggcgcctgggccgccggcgctgcttcggcggctgcggatgcagccgggacgcccgcagcggtcggagcgggcgcttcccccttcataatcgccgccattttttccagctcggcgatgatggcgctggggtccttattggcttcatgagtattctgaacgcattcgacctcgtcctttaaaaaatcggacgcctggaaaacaagatcaaaaatggcttcactgatgctggccatccgggcggggtcctcacggatgatgaaaaaaacatcctcgacggaatgcgccagcgtggagatgccattgagatccatcatcgcggcggagcctttgatcgtatgcatgatgcggaaaatttcgttgatgttatcttcgctgaagcttttggacttctccgcatcgagaagaatttcgtcaagctgatcgagcagcgtggttgtttcatagataaaaacatccaacatgggttccatacttggatcaatcgccatagaattcacctgctatcctaaagaataaattagagcctggcgccgcatacaagcggtaattccccctgtttatgaggcgtccgccggtaaaatattataactctattctttattattcggcaggttggaaaaaaactaaagaacaattgcttgtgttattgaaactttgaacgataattatattgaaaagattgtgccagcgatccaaagtaggaaatacctttggtttggccagtccaggtaggagaaggaaaatggcggatattttaaggatcacaacaccgctggtcaataaatcgcaggcgcccgacgcacagaaggcgctggaagctacacagccgtttgacctgcacaatatcacgcgcgtgacaaagcccgccggccaggaggggattttacggcagaacacggggctaaaccagcaggaggaaacctcggcgctgcttttaaacctgctcaaggatccgtctgtcgcggccagctcgttgaaaaacatctatctgctccaggaactcattaagctgttgccggtcaacaacaagccgttgacacaagagattcagcagcttttcgatcagttgatggtcgcgccggaggacattgccgacgagatgatgcgccaggagaacgcctctacctcgtttaagggcgagatgttcgattttctgcgcgagctgctctcacaaaatccaaaacaggaggggctgcgtcaggcgaccgtttattttctcaaggcgtttaacagttattccatgcgtgaaccaatgctgcattccgtcgcgaacagcctggagtttctctcggacagtctcgacagcagcaaggcgctctccgcgcggctggcgtcgctggcggcgcgttttcgtgcgccggacgccgcgcagaactttgacgatttgaaaagagatatgctttctctgttcaaggaggttgaaaatagtattctgttttcgccgaagctggccaaggtgctgtccattgccacctataatctctcgcgctttaacgataacgagttgtttttccacgaggcgacggcgcggctgctttcgcagctccatggggaacaggcgcgcacgcagtttttgcgctacattgagcagagcttttccggccgcccggagcacagccgctcggtggtcgagacgctggcaaagctgatcgaccggcagtcacagaccgacgagatcatgcttgtgaattccgaaaaggtcgaaaccattatccgcagcctgctatcctccccgtgcaactttacgccgctgcttcattttgtggtgccggtgcagtatgaggatatgcagtcgttcgcggaaatctggatcaatcacaacggcggcgaggataaggagaacggacgcggagcggacgaccactcgatccacatgctgctggttttcgagatcagcgacatcggacgctttgagcttgaattgtacgtgcgcgacaagacgatcgatctgtctctgttctgcccgccggcctatgtagaccgctacgcgcggatgggttcaagccttgccgggtgcctcaaggcgcttgacttccggcttggcgacgtgcattttgaaaaactggagcgggcgcgttcgctgatggacgtgttccgttcactcccatataaaaggacgggtatcgatgtccagatctaaaaagaacaaggccgttgcgctgaaatacaacgccgaggaggatgtcgctccaattgtaatcgcctcgggctatggcgaattggcgcagcgcattattgacgtggcggaaaagcaggggatccctgttttccgcgacgacagcgccgtatcgctgatgtgtatgctcgaggttggcagcaacattccccccgagctttatcaggttgtcgcggcaatctactgccagctgctccagacctccaaggagatccgggatggcatttcggcggccggacgcgcggccatgggactgcctgccggcggttccggccaatcggcgcaataaaaccgggaggaagcggacaggatgaatttggagctgtttgcaggccgtgcctgcgaattgaagaagatgaacaatgcccccatattgtttgggaaaatagaccgggtggccggcgacaggatggaggtggccggcgtcaaggagcagctgcctgaggtcgcgtgcggacagcatgcgaagattctgatttatgacgagacaggcggttttgaggtgctgatcgggcgtattgacgactgggaaccgaaacggctgattctgcgcgaagtcgtcagccttgttgaatatgagagacagcgtttttttcgtgtcggcgtggatctgccggcgcgcatttatgaaatttacgacgatcagctctacgggccgatcccaattcgaatcaagagcatcagcctgaacagcatgctgttcgaatgcgcgcagacattggtggccgagcagcgcatcgaggtggatccatcctttttcagtatagaggtggagcatctttatgcgacggtttcacgtgggcagcgtatgatcaacagcatggcctatgtcgctgattttgatccgctggccgagtgggaggaacagaagctgtgcggctttctgttcgcaaaacagggggatgaaatccgcagaaaacgggggacgatggagaagtgacggacgcagaggacaggggcagggaagaaagggttattttcgcgctggatatcggcacgcgcagcgtgaccggcgtggtcggcgaaattgaaaacgggatgcttcgcgttctcggcgttgaaacgcaggagcacgccgagcgcgccgttgtcgacggacagatcgaggatattgagcagactgcccgtgtggcgcgtttggtcaagcagcggcttgaacagcggctcggctttacgctcagcgaggtctatgtggcggcggcgggccgtgtgctgaaaacaaagcgcgtcgcctgcgcgctggagcttgacgaaaagaagcctgtcggccaggaggagctgtttaagctggagtcaaaggcgattcagcaggcgtatcaggcgctgcttgaggagcttggcggcgacggtggggtgacatactactgtgtcggccattccgtgattcaatacacgcttgacggttatgccttttcaacgctcgtcaatcatcgcggccggcaggcggcggttgagctgattgctacgtttctgccgagcgaggtggttgaaagcctctatggggccatgcagcagacagagctgacgatcatgagcatcacgcttgagccgattgccgcgatcagcgcggtgattccacaggagctgcgcctgctcaatatcgcgctggtggatgtcggcgcgggcacgtcggatatcgcgattaccaataatgggagcgtctgcgcttatacgatggcgacgatggccggcgatgagattacagagcgtgtgatgcgggaatttctggtcgatttccagatggctgaaaagatgaaattcatgctcagcgagggcaaggagctgattgcctactgcgatattctcggctttgaatacagtatcccatcggaggaactgcgccagcggattttgcccgctgtggaggagcttgcgcagacgattgcgcagcagattcttgaaatcaacggcgcgccgccgatggcggtctttatggtgggaggcggcagccgtacgcccgagctgtgccggctggtggcacagaatctttcaatcgatgaaaaaaaggtagccatcggcggtaacaattatatgaagcggatggtggaaacggagccgcagtacatcagcgcggaatacgcgacgccgattggcatcgctatttcggcgatgtccgcgcaggaccaggaaaatttgtcggttgtgatcaacggccagcgtgtgcgtatgatgcgcatgggcgcgatgaccttgctggaggcactgctgcgcgccggttatcagtacggccagatcatggggcgctccggccgcagcgtgacctatgcgctcgacggtgagaagaaggtggcgcgcggcggcgtgccgacgctcgccgaattcgaagtcaacggccgcgcggcgaatattacaacgccgcttgaagccggcgattcagtccggttcacaccggcggtcaacggtgcggacgcgaggcccttggcgcgcggcgctgtgaaggattttgccccgcttgaaatcgaatataacggcgaaacggtccgtgcgggcgtatatgtgaccatcaatggcacgccggctgaggcggaggatgagatccatgaagcggataaagtgcatgttttgcgaatcatcacccttggcgacctgctcgtgcagacggatgggtcgcttgaggcgactgttgtaaacggcgcacggcgcacggccgattacatcttaaaagagggcgaccgtgtgagcacggtcgcaggggccggcgccgccgagccgccgccggtttccccaaattccatggttgtgcagccggctgcatccgccgcgtacgaacctgcgcctatgcagcagccgttccagccctctgcgccgccgttgtccgcgccggcgcaggcgtccgaaacgtgtgagacgccgcgcgcggctgtaccgaatcagccggtgaagcccgtgctgcatgtggtttcgcgcgcggaggaaaaaccgcagccgccggagcctgccgtaccgcagcggcacggtgcggtgcagatcattctcaacggttcgccggtgcttttgccggcgaagccggacggcacgccaaacctgttttttgatgtgctcaactatgttgcgattgacccggatcatccgcagggagagccggtcatccggcgcaatgaccgcgcggcctcatatattgagccgattcatgacggcgatcggattgaagtctattgggggtaaagcctgctttgtttccaaaggcggccgtaagccgcttacgcttaaagaagatagagtgaggagctgaaatgtatggaaacctatattgtccggcagccgattctcgacagcagcgggaaagtgaccgcttacgagatcttatataaggaggatgaaacggcgctatataaccagcgtgattcccgggttgcaaacgcgattgaggagtttctgacagaactcagtaatgaaaagttccttgggggaaaaacagcgtttctgacatttacgcctaatctgcttatgaaaaatattccgcgcatgttctcccccgagcgcctcgttattcaaatcgaggataattccattgtgcatcctgtcgcgcaaaagatgatttaccgttatcgcaagcagggctacagcattgcgagcgccgggtttgagttttcgccgcgctactttggaatcatggacgcgctcgactatatcaaggtcaatttcggcgaaattgacgagatgcatccaaccaattccagcctggtcaatatcgtcaatatcgcgcacagcttccagaagaaagtgatcgcctttaaggttaacacacccgaggcgcttgcattgacaaaagagcttggctgtgagatgcttcagggcacctatgtcgcggagcagaagcagtcgaaggtgcaccgcgtcgatcatatgcagagcaacttcttccagcttatgatcgctgtgacaaaggacgagccggacatcgatgagatcgcccgtatcatttcgcgcgatgtcacgctggccttttcgctgatgaagctggtcaattccgcctatttcgcactacgcaaccaagcgaaatccgtacagcaggcgcttgttgtgctcggtcttggacagctcaaacagtggatttacctgttgagctttaaacgcgacaacggcggcgcctccgacgagctgattaaacaatcgttcctgcgcgccaatttctgcatggaactgtcaaagaatatcagcgattttcccatttcgccgtcggaagcatacatgatgggcatgttctccacgcttgaccagttgatggaggttccgttggagatggcgctcgacgaactgccgatttcggactatgtcaaaacggctctgcttaaaaaggaaggccgctgcggcgcgctgtatcagcttgtgctttgttatgagaaggccgattggaatgaaatgacctggcatgcgaagctgcttcagatcccgatggacatcattacacgcatctattttgaatgtgttgaatatgttaattccatctggaacagcctgctttctcagaatatggacggcgacgcacaggccgaggcggagccggtatccgcgcggtaagcatctgctgcggtgcgatgcagcggacagagctgcaaaaattgtgcctgccggaatggggcggtctggttcattttaccgaacaaaaaaatgttggatttgctttggttttctaaaaacatgtcgaatataataaattgaagtatcgcaaattaggttttaaatcagcgtatcttgaggaggagaaaatatttgtttaggaatctaaaagttagtaagaagattacgctttccttcggtatcgttatcgtattgtatatcgttgccgttatcgcgggaacaatcggcctgttcagtgtggcaaacggtttggaatctttctacaatcatgcatatccgattgtgcgcgagtccctgcagatcagtaacctcaccacatccatccagcgcgatatctggaacgcctatgtggtgacggacaacgcgcagatccagtcgcttcttgcaggtgtcgagtcgaattcgacgcagatggctgcttacgccaaggagcttgaagcgaaatatgatggcgacccgcagttgctttccaatttcaagtcggctctggaggcgacaaaagcgccgcgcgaaaagacgatccagtatattaaggcacaggatgataaaaatgcgctggctctcctgaccggcgaatatgcggccgcatgcaataacctgaacgcatcgctgaacagcattatcagctatgcggaagagaatgcaggggaatactatacaagcggcatggccgtccgtgtcatctgcattgccatcttgcttggaatggcagtggtgagtttgattatgacggtgctcatcaatatcaaactagcgaaagatataacccgcccgctggcagaaattaagtcggctgcggaagattggacaaagggagccatgaagtcctcggttacgtatcaatccaaggatgagcttggcgaggttgcggacagcatgcgctttgtttccaagacgctttccgagtatatcgacgatgtaaccagcctgcttttgaagatggcgcagggcgacctgacagtttccgccgatatggaatacctcggcgattgggcgtcgatccgcacctctgtcaaccagattctcgattctcttaacgatacgcttggccagatcaaccgttcctccgagcaggtttccagcggctctgagcaggtttccagcagtgcgcaggcgttgtcgcagggcgctacggagcaggcaagcgctgttgaggagctggctgcgacgatcaacgagatctcgcatcaggttatgcagacagcggacaatgcgcatgatgtcgatgagatggttacttccacaggcgccaatgtcaacatctgcaatgaaaagatgacacagatggttgcggcgatgagcaagatcaacgacagctccgcgcagatcagcaagatcatcaagaccattgaggatatcgcgttccagacaaacatccttgcgctcaacgcggctgttgaagcggctcgcgccggtgctgccgggaagggcttcgctgtcgttgcggatgaggtgcgcaacctggcggcaaagagtgccgaggcagccaagaacaccaccactctgatcagcggctcgctcagcgcagttgaggaaggctcgcagcttgttgacagtacacagcagtctttgcttgaggtggttgacagcgcgagcaagatcgtggttgctgtgcagaagattagcgacgcgaccaacgaccagtcgaacgcggtccagcaggtcacacaggggatcgatcagatttctgcggtcgtgcagacgaattccgccacggcggaggagagcgccgctgccagcgaggagctgtccagccaggcccaaatgcttaagagcctggttgcgcagttccagatcaaaggcattccttccaccggcacgccgcagctcagctattcccatattccggatgaagccggagcgaacgatttctttggcgacaataaatattgattgtaatttttagaaatcgctttgtaagatacgcttacaggagacgccgcagctgcggcgtctcctattttttgcgttgtgggatcgatgcaggcggcggaatggaaaaaattcttgccaatacgctttagtttttggaaaagacaacgaatataaagattgaagggtaaacggcggggccaagatggccggccggccgcttcacagacagcctttaaacgtttctgcgtgacggccgcgcgcggggatgtagaaggaacaatttatacgaacgcttttcacatggatgtgggaagcacacccaattacatggaggtataactatgggaatggtagtcagaagcaacatcatggcagtcaatgcgcagcgtcagttgggcatgaacaactcgtcggtcggcaaggcgctggaaaagctgtcctccggttaccgcatcaaccgtgccggcgacgatgcgtccggtctggcgatctctgaaaagatgaaagcgcagatcaagggccttgatacggcttctctcaatgctcaggacggcgtttcagtcgtgcagacggctgaaggcgctctgactgaggtccacaacatgctcaaccgtatgaccgagctggcgacccgtgcggccaacggcatcaactcggatcagaacaggcagtcccttcaggatgaaatcaaggagcttcagacggaaatcgaccgtatttccaaggcgacaaacttcaacagcatcaacctgctcgacggctcgcttggcggcggcacgtctggcgcggctggtgttcctgcgatcaatggggacggcttgggcaacttgactgaaactgctgcgaatgccggtaacactgtgattggtaaggccgcttttacagcccagaacaacttgaaggctggagacagccttacatacagcttgactgtatcagaggatggtaccgccaaggtgattgatatcacacttgaggtcagtgcagatggaaagtctcttacatacaatggtgagtctgttagtacgcttggtactacaaatcaggccaatgatacggaacaagcaaaggctttggctgccgccatcaacaaacatgcagatcttaagaagtctttcacagctgccgaaaatgctggtgatattactttgacccataaagtgaagggtgaaagtgctccgagcatatctctgattgaagcgccagctgctgcgggtgctgagaaagccactgctactactgtaactaaaggtacggatgcattccagtcaggggctccggtcagtgatcaagtctttacagtcaatggcaagaagtttatgtttgccagcagtgctgataaggcggctgccgctgaccccaatgtgactgttgtggttcaagctgccggtacgatcgcagaggacgacttggaaaagatggccgcattgatcgagaaggagacgggctacaagcctacggtgaatggtactaactttgaatggaaaagcgacgctaaaaacggtaaggccgggaatggactggttctccaaatcggcgacacggctgacagcttcaaccagatcaccgtttcgattgatgatatgagttccaagggaatcggcgttgccggggttgatatctccagccgcgagggcgctgccgcagcgatcgatacgattcgcgccggcatcgacaaggtttccgcgcagcgcgctgttctcggcgccacgcagaaccgcctggaatatacgatcgacaacctggataccacgtctgaaaacattcaggcagccaacagccgtatccgcgacacagatatggccaagatgatgatggagtacacaaaaatgaacgttctgacgcagtccgcgcaggcgatgctcgcgcaggccaatcagcagccgcagagtgtgctccagctcctccagtaataaaacagttaagcggccctttctaaacggggcttgacaattttccgttatgaagaagggagccgcccgcccgggtggctcccttttgtccatatcatatcatctgtccgaaaggaggtgtaaaaatgtatccaatccagaacagcatgtattccctcagcaatacgatcctgagcggatatacgcagatgaaccagatgcgcgcgatgctcgcagccagcggcaacagcaagctttctgcgatcagcggcgtatcgaatgtcaccagttcgacggcaaacaagcttgatgcggacagcgcggcgttcctcaaggactatcagaaacaaatgacagccctcaaggatgcggctgacggcgttctcaatccaaagaccgacaaactggctgccggttcgtcagaccgcacggtagcgacggtgaccggaaagctggaaagccagtccgattcctatgagctgacggttcagcagacggccgcgggtcaggtgaaccgttccacgtcgtttgtcagcaacggggaactgccgtccatgggcggcggtttgcagattaaaacggctgcagggacctttgatttcagtctgagcgccgccggcgcaaagaccaatcaggaggcgctgcaaaaattcgccgattcgatcaacgcgtcgagagccggtgttaccgcacgcgtcgtcacggaaaatggccgttcgtctcttgagcttgagggtgcgtcgggcagcgacaacaagtttaccgtttccgggacggccgctgaaagcctcggccttgataaggctgtgactgagagccgcgatgcgattttcacaattacgagaaatgatggtgaaacgtatagcggaacttcgtccaccaatgcggttgaagtcgacggcgtcagcatcaacattgccggcacgggaaaagcccagatcaaggccggcatcaacgacggcgcggccgccagcgcaatgcaggacctggttgacgcgtacaacagcacaatcaaatttttaagctccaacgaggatcggggcgtcggcgttctccagcagatgaagcgtatgatccagccgccggtttccgaatcatccatgtcgatgatcggcctgactgtgaaggctgacggtacgctgtcctttgaccaggatgtctttaataaggcgacggacgccagtccaagcctgatgggcagcatagctgaacgcgtcgccagtggaatcaagcaggatgcgcagcgcggccttgacgcgccgtccgccagcctggttggctcggccgccaagcagcagaatatgtttggcagttcggcgttctcgtccagccagatggattccatcagcatgatgagcacgtataaccgtctgggcgcatacaacatgtctaattattatgctgtcggcatgatgatgaacatgtttgtataacgcgtaaaaaagattcaaatccgcttgtggcggattcgcggggagaaatgtatcatgaatattggaaacgtcggactgtccggtgcgcgttacacggctgcgatggcgactgccgcgcaggctgatgaagccgtatccaatcagcaggagaacgcggcggctgaatcaacggtcaatcgcgataccttcgaaaggacgcagccggagcagtcggttacgtacagcaaaaacaagttgaacaaggctcaggccgatcaactgatggcggcggaagaaaaccgcacgcagagctttatgaacatgctcaaaagcatgatcgtcaagcaggggcagcagagcaacctgaccttgttcggcatggatctgttcgttaccccagagcagagcgcgaaagccgccgcgtccatcgcggagggcggcgagtattcggtcgatgcggttgcggggcggatcatggatatggcgaaggcgctttctggcggcgacgcttccaagatcgaggagctgcgtgaagcggtcgagaagggctttaaggctgcgggcgtcgaattgggcggcaagctgccttcgatcagtcagcagacccacaccgaggttatgaaacgctttgacgaatgggccgcggaagctaagaaagcatcgtcggcctccggcgaagcataacgggaagaacaaaaaggctgcaggaatttcccgcagccttttttgtgtatgtagatgtattatttgccgccctgcgcacggacatgtgcagcgaccttgacatcctcacgcttgatatggttgatcagccagccggcgatactgctgttcaccttaccaacaagcacgacggtcggaccttccttatttaactgttcggcaagctcccgtacaacgcgcttgaaaccctcatggtactgtttgtggttggcgtaatcaggatatttgtaacgaagctggagcgcctcctcgtcaccaaaatgcttggaggtgtaatcatataggaattttgttgtttttgcgacctccgcacggcccttgccagtagcgcaagctgccagcagcgcgttgattgcttcaatcagctccttgtgctgtgaatcaatcattgcattgcctgtttcaagatccttgctccatacgtaagccatttttctttctcccttctaatctaatgcgtttgtatgattcttattatataccttgtttgtgtacaattcaagggcttttaggaatttctttggaagtcagtggcgtggatgagcgcgcacctgtaaaattgctttcacaagcgcggcggaaacttccttagtggaatgctcacgccgcagcgcgtcaatttcgtcggcttcagctacgacatattccggctgtaaaaggttgagtgcggcggccaccgcatccttgcggcatttgtcgcactggcagcagtgaaatttagagaaggcgctgtccagccggtcggagacaagcagctccatgatattgacgacagcatattcgcgcttgaccgccgggatggccaccccgttgtttttgcgcgaaaaaaggcggctgcgcagatctgaaatcgggttgtcctcgtcctcctcagcagacggggcgggtacggcctcgggtgaggaggcgggcatatccgcagctgccgcgggtgcttcagatgcattggcgggaggcacgcttggcataatcagattataaatataatccttatcgaattccattttgggttttgccattataaaacgcccctttcgaacaactcgtcaagcagccgctgatagtcctgcacagctttgcttttgggggcatagcggatcatgtcgcggcgcaggatttgcgcctttgttaaatcgacgccggtccggatggtcgtgcgcagcagggggatattaaaggtttttgccatgtcggcggctgtctcacggatgacgttgttgatctggccgcgcggattgaaacgtgtcagcagaatacctgcgtttacaagacctggattgttgcgtgcccgcacgtgctcaatggtttcgttgagctgcacaatcccctgcaggctatacaggtcggacaacaccggcatcaggatcacattggatgcagaaaaagcgttgaccgttagaacaccgagcgcgggcggcgaatcgatcaggatgtaatcataaagcttttcaacggatttaagcgcggatgaaagcagaaattcacggccttttccggtaaactccagctcgataccgcttaacatcatattagaggtgatcacgtctgcaagctctgtatgctggatcgcctgaaccgccttcagttcgcccttaagcacctgatagatcgaattttgcagctcaacacgattgtcggcacgcagactaaaagacaggtttccctgcggatcgaaatcgacacacagcacacggtagcccttgtgccgcaggcccatcgcaagggcgtttgtcgttgtcgtttttccaacaccgcccttttgattggatacgcaaatgatcttgttcatcctgggtttctcctttttttgcgcatgtaaaatccacgctttttttattatacttgatcgtgcccctgcttggcaagcggggaacagaaaatcatatgcggttttataagctcaaaacggcctggctatggaggggcggaccgcgcgtgaacagatgcgcaaaaaaatagttgagcagtgcttattttttaggaaagattgtttagttttcgctaagtcgggcgataagaaatagtaggaaatagtttatgattattccatccgttacggcaacggttaaagaatcgagggatattatgaaaatcaatccggccgctgcacatggaatttatagaacaaatcttgccggctataagtccgccttatcggcgcaggatccccagacaagcgcgggaaagctttccggaaacacagatcatatttcgatcagccagtctggcgcgcgccagcttgaggcggagaaagtgagcaggagcattttggacgacatcaatacgccggcctctccggagcgtctggcacaattgcgcgagcgtgtgcagaatggcacctactacattccgactgaccggctgaccggcgtgctgatgcaacgctggtttggcctttaaggagcgtgctcatgacgaaagaactcgatatattttatgcttttctggaggattacgccgattttatggagggcctgtccgatcaggaggatggaaaatatgcggcgcttttgtcttttgacgcgcacaaggttgaccatgtaatttccgagcagcaggctgcgctgatgcgcctggacgctatggaaaagcagcgtgaaaagcttcaggaggaggcggggcttggcggatgttcctttcgggagatcgtcaggcgcgccgacgaggaggaccgcgattatctgcatgcgctgttgatgcgtattgagtcggctgtgatggatatccgtttccgcaatgcgaaatccacatcctttgcaagggacagcctgcgtgcattcagtgggaacgccgactcgcccgggcagcaggtcacgggtggttacacatcagaaaaaaaggtagtggagggcccaggctcgccgctgtttgaaacaaaaatttaagtggaggggaatctgctttgtcgacattacgacctacctttatgggatttgatgttgcaaaacgcggcatcatgacggctcaaaagggtatcgatattacaggacagaaccttgtcaactgggacagcgccggttatacgcgtcagcgcgtggaacaggtggcggtcggggtgaatccgtatacatcgcgctatggcagcaaccggatcggtattgccggccagggcgtcgatatccttggaatcggccagacacgcgataaattccttgatacgcgttttcgcgaactgacttcggaagcgggctactacgatcaggcgcagaagatcctgggcgaccttgaatcggtcatcagcgactttgagccagacagcgacagcggtatcggcgcgatgctcaacggtatcttaaacgcattgcagccggacacggagcaggccgattccgagacgtatgcatcccttgtgcggagcgcctttaaggatatgacgcagacgctccaatatttaagcggtaagcttgaccgtgttgcagagcagcagaagtttgatctcagcgtatcggtgcaggattttaacaagatccttcaaaagatcgtagggctgaatgaggcgatcagcaacgatcgcaatgtgcttcaaaatgcgcactatggacccaatgagctgcttgacgagcgtaactacctgcttgatgagcttgcagcgtatggtgagatcggcgttacgacgaatgcggatgggactattacgatcgagatggatgggcacaccatccttgacgggtccaaatatgatgcgatggagatgggtgagaatccgaacggcacagttgaactcaggtgggtgtcgagcggtgataaaatccaagtgacggacggaattctcaaagcgacgacggatttcctgaatggccgtggccccaatatcacccaggaaggcgaaacgacatatcgtggtgtccgttattatcaggatgcgctgaacatttttgcacatcagctcgttgaggtagccaacaacagtatccccaattatcaggttgatgcggctggggaattgatactcgacgcggatggcaatcctgtattggatccagatcagccgtatcgcaagctgcttggttctatcagcgatcagccggatgccaatggaaaatatgtggttgacccggacggccctgttacggcggcgaatatttccattacggacgagtggaatgctgatgcgtcctattttgtcgcacgcaaggatgatctcgacaacaagtatgttgtggatttgtataataagctcaagaacgacgacaatgttttccaggggcgcggcgagtcgtttacagggacgtttaaggattacctgacaggctattctgcgacgctcgcagaagatcagaactattataagaaccgcctccagtcaagcaacaacctgctctatacaacggaggacagccgcgatgaggtttccggcgttgtaatggatgaggaagttgcaaatatgatgctgtatcagaaatcgctccaggcggcctccaggctgatgacgacgcttgatgaggcgcttgatgttctgatcaacaaaacagggcttgtcgggcggtaagcaaaggagctgaacggaataaatgaggattacgcagcgtaccatcagccgcaactacaagcggcagcttaacacagtaatgaccaggcgcgcatccacgatggaaaaggggaccagcggccttgctttcagccgcctttcagacaatgtggcggcaggcgtgcgcgcgatgaaggttcaggaggagcgcctgacgagtgaacgtcagttaaatacaattgaaaacttccgtgaggagttcaagacggtcgatacgaaccttgattcgattgacagcatcttggtcagcgcgcgcgacaaggtggaaaaggcgctcaatggaacaaacggcggcgatccgcgcgaggttattgcaaaagaaatcgggagcctgaagaaacagattttacagtttgcaaattcacaatatgccggaaaattcctgtttggcggcacgaataatgcggaagcgccatttaccgatgacggcactggcaagctctgtttcaatggtattcccgttgaggacatccgttatgatgaagcgcgtcagacctattattatgtggcgccggggacaaagcccccgaacgacacatatgacgaccgtgcgggaattgtgccgggcagtgaaaacatctatgtcgatatcggcttggggcttaaagtgaacgacaacagcagcattgatccgcgttccgctttccagacaaatttcaacgggcttctggtgctggggtttggcccgtcagtgacaggagccaatgggaccgagtcgcccaacagcgcgtatgatattatgtccgaactggaaaaggtgcttgcagaccctgattttgaccaggataaagccgacgacctgtttgatcattttgaaaccgttattgacgatatgcgtttctcccgggtcgatttgggtacccgcatgaattttctcgaccgttccgccgaccgtatggagaatgacattgtcaatttgacgacgacggaaacaaatctgatttcagccgatccattcgaaacgtcggttgatctgaagcagtgtgaatacacatggatggctgtgttgcagcttggaacaatgctgctgccgacctcgctgcttgattttctgagataaggcgggttttttcaggtttccaccggagctgagagagttaaatgaattgggaaaggaggtgtttttgtgcagttaattaatattacaagccagccgctcaaatatgaaattcatacagaagcggcgcggctggagatgaatgtgccgaagaacccgcagggaacggtaaaacgggcgccttcccaaatgcgcatccgtacgaaggatatcgaggtacggctcgataccactgaaatgcgcgccagtttgaatctgcggtcgatcgcctcttggaagcaggtgtgggcgcagcaggggcagcaggccgcgtatgaagtgatcggagagaatgtgcagacgggcaaccagatgcagcggatcgatgacggcgtgacaattgggcagattgtccgacagaagatgctgcaggccgctgactgcacgacttacacaacgtatattccttcagagggtacggaaatctcctgggaccccgcgcagatcaacatcaactatgatcccggttctgttcagacggaatggcagattgcgcagaatgttatgaattatattccgggaaagttccagatggagattttgcaatatcccaaagtaacgatcgaatacttgggcgaaccaacatatgttccgcccagtgcggcgcccggttatgttgaagaacagggtatccgcaaaaacaagcagccagggaatgtttcccatttaccgggctgcttgttttcgttatcatattgatggaggtgtaaaccgtttatgctgaaaatattgacaagggattttggcgaggttgaaatcagcgaagatgatgtaatcacatttacagagccaatttttggattcaaggattacagccgttttgctgtgctgacagaggaatccatagggcctgattttgcctggcttcaatcggttgaggatgcatctgtctgttttattctggtcaatccgagtacagtggttggacaatataatcccgtcttgcccaaacgcgtggcggagctgatcgaaacggacgagccgatgttctggcttgttgccgtgctgcgggatacgcttgaaaaatccaccgtcaacttgaaaagcccaattgtaatcaatcctgtgagtaagagtgccgcgcaggtaattcttgaggacgatctgccgattcgctatccgctgatgggatcgaaaggagggctataattgctggtgcttgcaagaaaacccggcgaatcactggtgattggcgacgggatcgagatcaaaattatcgatgtgaccggtgaaaaggtgcggatcggcattttggcgccgggagatgtaaaggttctgcgcaaggaattggttcagacaattgaggaaaatcagcaggctgtccgcagcgacattgggccaggcgccgtgcgcagcctgcttggagggaggggtactgtttaaacagacgatgaatgatcaggtttaagcagtatccggccgttccaatcagcggaatgcctgccccttttgattattgaggctggcgatgaaattttcaagattatcacgggattcccggtcgatatcgcggataacgcactgatagctgcgcatttcctgtcccatatcaattgcctttttgacatcaagcaggacatccttcaaacgcggttcctgcatatttaaagagatggtttgctcgtcctccagaatataaggcgttgtaaattttacgccgcgcagggcgatggagtggatttgggcgtcaaagacggtttcgcgataacgcggttttttgccgaagaacagaaaacgcttatgcgaggtgtccagcacgcgggcgatcaattttccggtgagatcgacatcgtaggaaaaaacagaacgtgccgctggcagaacggtttctgtgaccgatacgagacgcagaatatgctgtgaggagagatagacctcgccgacatagctgacgacctcaattccatcctgtattctaacaattttcaattgatcgccgagcttgtaaagcggaataaattcgcttttaaaatcgacgcttttatcctcgatcgaaatctggatgacaccagtatcggcaacgatttggtcgtcaagcgttttaagaaccgctgggaaccttgaattcgacatgttgtagctcacgctgataagcctccttgaacaatcaaagccgcagctttgctcaaaagacgcaccggcatatctttgaacaaaaacgggcgataactatcattattgtacaccaaaaatgacggcttgtatagagcacaagccgcgattcctgcaatgaaatctatgaaaagaagggttgaatatgggcgcttttccaaatgcggttttgcgtataattgatctcttggcggagaaaagggattatttcgcattgtatgagcaggcgagccttgagatgctctcgtgtgaatcggatgggcttgaggaaaaattagaacgccgggcagtgataatcgacaggattgactccctggacgcacagatcgacgaggcatgtgacaatcagccgctttactgccgcgccgcacgcgcggtctgcggccgcggcgagctgccggaggaatggaagccggtttttgattgtgcgatgcagatccgggccatagcaggccggctgccggacattgatcttcagattcagatgcgcttggagcaggagcgcgatatggcaatggagcagatcaagtcgaacaaccgtggacaaaatgcccaggctgccaaatattacagcgccatggtgggcggagcggctccgcgtcccggccgctttggatccgcataaacatcggcaggcccaaaatatagctgcataatctctactttttggacgactttttcggatatctcctttagtttccggcgttttgtacgacaattatgttagagagattttagcaacggaggcttcattatgaatataagttcttcaagcagcagcacctatgtaaataatgcgagcagcaacaagggcttttctggtcttgcgtccggtatggatactgaaagcatggtcgaggctttgctttccggcacacaggccaaaattgataagcagaatgctctgcgccaacagacagtttggaaacaggagatttaccgcgaaatcatcacgcagatgaatacgttccaaaacaaatattttggaagctcatcgagcacaaatttcttgagcagcacgtttttcaatgcgatgaacgcggtttcgtcttcaagcgcctttaaggtcagtgcgtcaagcggtgcgacggttggcagcacgtcgatcgcggtttcacagcttgctgaagcggcgaagctttcctcggcttccggcacgcgcaagctgtccggtgaaatcaaccttgacgcgattcaaaagcaggttgcgggccaggcgcgcgatgtgacttttgtagtcaataataaaacggttaaagtcgattttaaggacttgtttgtcaatgacgacggtaccttcaagacgccgccggccacgcagcagcagattgcagaccggctgacggaggcattcgccgcgcagggctttgataaaatcaaagcggaggtcggcaacgacggcgagattgtaatcaccagctcaacttgggatgacgacaatggcgtcggcgattcgatcactgtatccagttcttcaagcgcagccggcttgaaaatcctgggcttgaacgccaatgcaagcgcggaggtttatacgggcgcggatggcaaaaaaggcatgaagctggagtcttcgcagccgattgcgacaggaaattatttttctgtcgatgtaacctttaatggcagcaagacgacgcttaatattgatatgacagaggtcttgtcaaagggaacgaaggcggagcagtatcaggcgtttgcggctcaggccaatgcgcagatggacgcggcttttggcaaaggaaacgccattatgaagatcgatgatccggcaaccggcgctttcagtttcgatgtcagcgcgatgaagggcagttcgatcatgctctctggaacgaacgcgacagaggacctccttggcgtcctcaacggcgagagcaaccgcatcgggcttggcggatcggtcaagatgtatttcggcaacgcctttgttgacggcaaggcgcagcttgagatcaacggcaaaaccatcaccatcactgaggatatgaccgttggcgatatgatccgaaaagtgaatgcgagcggcgcaggcgtgacgatgacgtatcaggctgaggcggaccgcttcacgctgacagccaacagcacaggcgcagcgttcgatatcaagctgggcaacaccgcgttgtccgaggcgatcttcggaaaagcgcccgccgatccttccaagccggatgcggggggatatacctttaccgccggcaaaaatgcgaaggcgacggttgacggcgttgaaatcgagcgcagcagcaatacctttgaatttaacggcctgaatattacattgaccggaacgactgataagacggaaacgattacggtttcacgcaatacagatcagatcgttgacggtgtcaaatctttcattgaggattacaatgcactgatcgataagctcaattcgctgatcgaggaggacactgattaccgtgagtatgctcctttgaccgacgcgcagaaaaaggaaatgagcgagaaggagatcgagctttgggaggagaaggccaaaaagggcttgctgcgcaatgacagcacaatttcgaccttccttcagcagatgcgcagtgcgatctatcagcgtccggccggcagtccgtttgcgatttacgatctcggtatcgaaactggcgagtgggagacaaaaggcaagctggttatggatgcggacggtgaagcgacgcttcgcgcagctattgagagcaatccggacggcgtggtcgctttgtttacgggtgagcagggtcttgcaagccagctcgataaaattcttacaaatacagcaagcaccagctttgtcagcggcaacagcagaggctcgctggtggaaatcgccggttacgctgaaacagcgtccgataaggataatactctgtataatacaatccagcagatagaccagaagattaaagatttgaaggctgcgtatgaacaggaaaagaccagatactggaataagttcaacgcgatggagagcatgatccaacagatgagttcgcaaagttcatggttggcacagcagttcggctattaatgctgcaaaatcaatgaggtgaatcaaatgccggtcaatccataccagcaatatcaaaggcagtctgttatgacgatgacgcagggcgaaatgttgacgaagctttacgacgaggtcatcaaacagatgagcggcgcaaagatttgtctcacagaaaaggacctaagcggcgtcaacaatgcattgcaaaaagcgcagcgtatcttattctatttaaaatcgacgcttgattttaaatatgaaatttctgggaacttggatgctttgtatgatttttttatcgagcggaccgtgcaggccaatctaaagaaggatgcggcgatgcttgacgaaatcattcctatgattgaggacttgcgggatacgtttgttcaggcggaccgtaatgcgcggagcaaataaactgtgagaatgtccgcggctaaaaagccgcggacattttttctttcggaagctgctttattttttgagaaatcggtcgataaaataatttataaggctatgtttaaaatctattcgatttcccggctgcttcggcggctggctgtgagggatgcatatggtctggaaaagattcacggcgttttgtttggcggctgcgatgatggcggcaaatgtcgccgatgtggcgctgctggccgcgccgtttacaacgaatgcgcgcgcttcaagcgatgttgaggctgcgacgcttggttttataaagaaatcatgggacgatgataaggaccatccagaacgcacaacggttgtttcaggcggttcggtcgatctgtcggtttccattaaatctgggtatgaggaaaacaaggaaaccagcttcaattatgattcgacagacggaacagcgcctcagggcgatgatatagtgatcacgggaactggaaatacacgccgcctggatgtatcggatagttttccaacgattgagaagcagacggtaatgataacgggcaactattatgcgatcaagggacagggcaaggcgcttgagaaaatcaatggcgctgaccgtaccaagattgacgcaacggtcgacccggaacggattatgcagtacggcgaattgactataaaagcaacccagggtgaaattgtcgcaaatggaaagtcccagggcggagctacatttactgttacagcgccggagtttctttcaaacggcggcgcggaaaacggtctgtatggatataatggcggcacggtgggttccagaagggcagataatggcgatttgatcgttgaaatccatccgccggcaagtacggcaggcaggctggatgatttgacctttacaattacgccatccaaggtatatgagtatttcgttacaccggataaacagaattcggccggtacaaataacttttatttaaaagaggacggtacgccatatgcggacgacgaattgctcgacaatggactgccgcctgtcaagacgatgaacgacgttattcagaaggatgaggaaatcacattttatctggatttgccaaaatcgaatacactgctgttgacggtcatcaaggcaacggcggcagtggaggaaattgccaacgatatcaaaatcagcgccaaccgcaacgatgaaaaatttatcaagctcgatccgggtgatgcgttgaattggatcacgactgatttttcgctgcgcaattatcaaaatcaatataacgacaaatttacaatttcatgggactggaaggccgacgattccgcctatcaggataatgtccatattggcgagagcaacaatgagtggatcggcgcgaccattgagcgcgaaataaccgatgtaaagggtaagcttctttatacagtaaccttcaaggatcgaaacggcaaggaaacgaaatccgctcagcaggagattgatattgtcatccgcggcactggagatccgccagtagcgacgttgacagcccaatggctcaataaagatgatctgagcagcggcgtcaacgatgacgccaataagatccccatgaatacggagcttaacaacaacggcacgcagctcaagatggacgtctacaagggcggcgtcatcgggtacaagaacccgcagagtccgtaccgttatgaaatcaccgccagcatgggtgcgcgccaaagctgggcaaagtatatgatcattgatgcgtctggcagcacggatgcggtcacagtacaattgaatacaaccagcggtattcaggattatacgtttggcagcgaatttaataacccgtcaatcagcaacaaggatacagcggttaatatccccgttcagattaatgcggcaaaaccgggaactgtaacgctgacatttcgcttttttgtagaggattcaaagggtaatcctgtggaattggattacaagccccgtgtgacaattacggtcgtcgatacctccccaagcgaggatgcgacgctttcgtcgcttgttatgaaggatccgaagggtcagtcgatcgatttcggcttcactccggaggcgacacagccgtttgaaattaaggtgccgttcaagacggaatcgattacgttggaagcgttccgcaacgacgacgcggccaacaagatgatcgcctattacgcctatcaccgggatggcggattgacgccggtttatggtacggaggacaatccggaaaaggtggaggccggcaagccgacagataagattccgttaaccgagaatgtcccggtttacattgaagtgacggtgacggcgcagaatccaaattttacaaagacatatacgctccaggtgacgcggactccggccagcaccgatgcaacgctctccaacatcgagatttacgatgagagcgacaccgatatgaaaaacaactatctgaaggactttaaccctctccagatggacggctatatgatcgaagtgccgtataagacggactggctgcgtgtgaaggtaccgacaactgacccaaatgccgccgttcagtgcgatccaaagctggaaaataaggttttgtttggcgatccggaatggatcaggctcagtaaaatgacgccgaacgaccagggcgtgtatgtgctgaaggtcaaggttgtttctgagcagagcattgaccgttcggcaaataagcagcccgattttacgaaacccgaccgcgaatacaccgtgcagatacgccggcgcgatccaagcgatgtatcgacgctgacagagttgaaggtatatgatactgacgataaacagttgacgctttcaccggcctttacagcggctcagagcgattacaccctgcgcgttccgttttcaacgtcaaaaatcagggcgtcggtcaaaccgcaggaggattctgtcagccgtatctttgcagtttatggacgccgcggccagagcgattacaagaagtggaaaactgttgatatcaatccggacggttcgatctccaaggatattccggtagacttcattacggcggcttacgaccacgatgaaatctggattgttgtcggatccgaaatggcatatggttatacggagcaggaattgatcaagatggtgattgacggcgacaagtcggaatatgtttcggtttaccgtatacgtgtggagcgcgccgaaccgagcgacgatgcgacgctgaaatcactcgtaatcaatgaccaggacggcgttgatacaaagaagatttcgttcaatccggatgttgagacgtatgaaatcagcgtgccttatgagacaagagaggttagctttgtgccgacagcgaaccacgagggcgcgcgcattaaaatccagagcaatcgagacagtattttgccaggcgttataccgcccagatggtacactgtgaatagtggaacagcgtcaaagaactttgacttgccctatgcggtcggcgatgcgacaacgacctttacaatccgtgttgaggcggaaaattacgattatgttgacccgccttcttataaagagtacatcgtcaagatcacacgtgaggagccgagccatgatgcatatctgaaagcgctttcggcgaccaacaccgagaattggcagccggacccgtttatcaggacaacgcttgattatgaggcgacggtcaaggaggggtcgtcaaccgtaaccattacggcgacaaccaatcatccgggtgcaacgcttacaatcaatggaatggcggctcagagcggcgtcgcaagtgatccgatcgatctggtcgatatttatacaacgattgagattgtggtaacggcgcaggacggcaccacaaagatgacgtacacgatcgagttttacaatcagaacctggttgaaaaaacaaacaatgctgatctgcgcagcctcaaggtcaattatgggttgatgacgccgaagttcaagccggcagtcactgaatatgaggtgacggccacggaggatacatattcggtcgatatcatcccgcgcacggacgaccggcttgcgacttatgaggttttcgccgggaccaggaagataggcgattacaataataattacgccttggcgcttgaggatggagaaaatgaggtgcgcattgtcgttacatcgccggataagactgtgacgaaggaatataccgtcatgatctaccgcaatgaggaggataagctgaaaaatctgaccccgcttgaatcagaggatgtcgattatgagggcagcggcgacacaatcatcattatgattgaccagtatccgcgcattggagcaagcgtttttgaggaattgaaaaattatccggacaagacaatcattttccagggcaacgattattcattggaatttaaggcatccgatcttgcaggccgcgtgattccctcgacagagatttacgatttccgcatgtcgttcagtccgccggatgaacaggaggatgcgatctgggacatcatcgagtcacgcagcggcaatgatgatctcacctccagccgggttgtaatggcgtacttcccgcatcacggatcactgcctgcgaccgcgatcctgcatatgtccattggaaagcggtacggtaatgaaaccatctactggcattattacaacgaggaacgtgatagaatcgactattacggaccggttcagacaaacgcacagggcaccttcgcggttaagatcgaccatttttcgacctatgtgatgacggagcgtcactccatcgtcggcgctgaactgcgtgtgggtgaaaccacattggctccggacggcggatttttgaatgacgcggcggatatcgtcaaggtcaatccttcgacgggtgccgcaaaggagtgtaaatgaaaaagtttcttgttgcaatcggcgtgctgctgtttgcagccgctctggcattcaccggctttacattggtaaaaatgattcaaaaacagcaggctgcgccggcgtcggcgcaggatgacgccgcatcagcggcgtcatccacagccgttgctctgccgcagccggagctaggcgtttacaagctggtggaaacggagatggatctgcttgaggcgctcgattacgaaatcaagcagaatcgggatacggttggctggctgattgttccgaacactcagatcagcaacagtgttttgcaggcgcacgacaatacagcgtatctgcggacagatgaacgccatcagccgagtatttacggctgctattttgcggattatacttgttctatcggtccgcgtgaggtcctttcgccaaacacggtgatttatggacacagtgatctcaaggataatccggatggcccgcgcttttcacagctttttaaatttaccgatccagagttcgcaaggcagaatccttacattcagttttctaccatcgatgattttatggattgggaaatctttgcggtattttatccaaatgttgacatgaattatattgaaacaaatttgtccggatccgagcttgttgcgctggcgaacgaagcaaaggcgcagtctatttacgattacgatgtgacggtcggtgaaaccgataagatactgaccttgtccacctgtacagtcaagtacggatcaaatgattatgagcatcggttcgtggtgatggcaaagttggttccggaggggacggagaaaaaagtaaatgctgatctgaaagaaaaaacatcaacggatcaacaaacggaggaataagcatgttttacgactctttggcctttcaggcaatgagaagcagcttaaacggtttggcgattgaacagaacataatcctgcacaatcttgccaactatgagacgcccggttataaagcaaagagcgtcaagtttgaggatgtgctcaaggagtcctcacgcaaggacgggagcggccggtatgattttaaagcgaccgtttttgagcaggaggatacgacgatgcgtcccgatggaaacaacgtcgattcagatgtcgagagcctgaagctgtatgaaaattatgtgcagacgctttatctttatcaaaagatcagcggtcagtttaccaacatgaactatattcttgagcaatccgccaaataaggaggaaaaaatatgtctttcatgaagtcgatggatattgtgggatcggcattaaccgcggaacgctttcgtatggatacgattctgcaaaacattgcaaactccaatacgacccgaacaccagaaggggagccttaccgccgcaagcaggttgtgttccaggagcgcgcaattgattttcaatcggcgctggccgacgcctctaaccggatcgagcgcggcggggtgcgtgtgaccgaggttgtagaaagccaacgcgattttacaccggtatatgacccctcacatcccgatgcaaatgaggatggctatgtcatgtatccaaatgtcaatttgactgaggagcgtgtggatttgatggccgcatccaacgcgtatgacgcaaatttgacggcgctcgctgtcgttaaatccctcgctctcaaggcgcttgaaatagggaaggcttagggttgattgcctgattgcacatttcaggctcaaaataaaaagtccggttgtatccccgcccgttttccgggcggggttcataaatttgtgaaaggggttcggcctgtgagaaacgggatcgacacggaatattacgcgcagcatatccagtgcacgcgcgatgccaaaagtgagtgtctgtatacggttcaacaattgctggagctgtgttttgcggcgcgcgaacatgggatgctgaaaatggatgagctgatcaacgaccgtgtccgctatccggatgcttttttgagaaaggctgtcgctttggtaatagaggtatccaatccggataatatccgcgatgtgctccataattatatatttacatcgagcaatgttggaaatcaaaagttcctaaattgcatgatgattactgaggcgatgattgcgctcagcagaggtgaagatctcgactacatttttacctatttggttccatcttttttcggatttgaatatgaggccgaatctcgcaatatataccaacaatttaagcaaaatttgcggacacgtggaacatagtgaaagtccattttacaaaaaaatagccgtcgcggccttatttgaacatagcaatggtaatataatccttgggtttgttctataaattaggcgcggcggctctggtatttctgctggcaacattctatgcatatttttcatgagtaaatatatgatatttgatataaaattgtatattttttctgtaacaacacacctctgttctaaaaaggggtcgaatgaaagagaatcttgttaatttttcatgaaatttggggctaaaatgtatatatggagtttttacgggttgcttttttgtttctaaaaatatatagtataactgtggatattttgttacaaagtcgtgaataggcgattgcattgaatttgagggaattcatatagctgtaaaaaattgcatatacaattttttgcttatgtaacaagtataaatctgtatattttgcgacaaatgacagttgcctttgataaaaaacacagcccgttcataatatggtaacagatccgtcgtagatttagaaagagagaaagagggcgacattaacagagtggacttccgttagaggaggggtgcccgctgtgtttatgtcgctgaaaggatggtttatatgtttatagcgccgattcagccaattgaaacatttgaggagatgcgtgcgggacaaaagacagcttcctctgcatccggtatccctttcgcatcgctgttgcaggagtctttggatgagctgcgcagaagtcaggcgcagtctgagaaagattcgattgatttggcgcttggacagggcggggatttgcatacgatgatgataaattcggccgcacttgatacggctgtaaaaacgactgttcagctgaccacacgtgctgtgagcgcatataaggaaattatgcaaatgcaggtttgatttcttaatttcattgctttgggccggcgcggtccccaagatcatgaaaaagttgggtatgtggcagaatgaatgagaaaattaaagatggcgtaaccaaggtgaaaacgttttggacgggacttcccaggaagaaaaagattatttttacttcttcggctgcgggaattgtcgtcatcgctgcggtggttgcattgattctaaaccgtccgtcaggcaatcaggtcctttttcccgatatgacgagggaggaatctcaacaggtttacgcaaagctgcaggatatgggcgtgcaggctgaaatcaacagggacggacaggttgtagtgcctaccgaggactgggacaatgcaatttttgaaatggcggcgcagggatatccgaagtcagaaccgaattatgatttctttttgagcaactcgggttggacaaaatcggaatttgaacagcgtcaggttttgaaaatgcaggctgaggatcgcatgcgtcaaatcctgatgggacaagatggaatcgaaagcgcagatgtgagcttttcgattcctgagacgagcgattacatatgggatcagaataacaaagaggaaagtaccgctgcaattacgattaaaatgcgtaagggagcggagctttcgcctgagcgtgtgcaggctgttaaaaatctggcggcatattctatcccaaacttgacggcggacaacgttgtggttgtcgacgccgctactggcgtgcagatggaagctgcggacgatgaaagcgcttcgatgttcagcgacaagcgtttagagtttgagcggcaaattgcgcgcggcattgaggacaatattatacgaatcctttccccgcgctatggggttgacggcgtaacggctgtcgcgcgtgtggagcttgactatgacaagatgaaaacggaaacccgccagctcaccccggaggatactggcaagggcgttatgacgcattttgaggagcaattttcccaaaacggtcaggtcgctgccgagggccttgtaggtgaggaaaataatacagatgttccaaaatatccgaaccaggtgggtgcaggcgacggaacgacaagcgattacagcaacagcattgattatgacatcggctatgttctgacacagattgaaaaaggcgagcctatcttaaagagcgctactgtgggcgttgtcgtcaatgattcggcgtttgatgatcgtaagaaagaagaattgaccgatctgatttccaaaagcgtcaacatccagccggaaaatatcagtgtgacaaatcttgactaccctgagcctgagacacagcagacaggtggcgcaggagagggcgatggcgctgccggcaacagcatcctgccaattatcggcgtgggggcgctgctcctgttgttgattttgattccgatcatccttctgctcctgcgcaggcgcaaaaagaataaggtgcatgctgccgagcaggccttgattgacgctgaaaaagaacgtcaggctcagatggaacgtgagattgcggagcacaagctgatgcttcagaatgaggcgcttgcgagcaaaaatgtcaaggaagacgcgatcatgcaggaagtgcgcacgtttgcagagcagaatcctgagattacggcgaatcttatcagctccatgttgagggaggacgattgatttggcgacaaaaagcaagctgacagctttgcagcgtgcggcagtcatcatcatttctcttggtgcgcagcgcgcttcggacatttataaatttttgaaagaggaagaagttgaacagctttccctcgaaatcgcaaaaatggaccgcctctccgaggaggagatgcaggaaaccatagaagatttttatgggctgtgcgtaacgcagaaggttatcaacgagggcggcaccatttatgctcgcgatgtccttgagaaggcgtttgggccggagcaggccgcttcgttcatggcacgcatttctaagtccctgaaaacacaggcgtttgaatttatccgcaaggcggactataagagtcttcagatgatcctgcaaaatgaacatccgcagacgattgcgctggtgctctcctatgcgcgttccgaccaggcttcaatgatcatcgccgagctgcccaagcatctccagatcaatgtcattaagcgcatcgcagatctgggcggtgtaatgcctggaattgtcgctattgttgaggaaaccttgcagaaacgctttgcctcgattatttccaccgatcagatggaggtcggcggtgtgccttacattgcggacatcatgaatcatgtcgaccgcagcacggaaaagtatgtctttgacgagttgtccgaaaacgatccggaacttgccgaggagatccgcaagctgatgtttgtgttcgaagacatcgcaaatctcgacagcatggctgtacagcgtttcatccgcgaggtcgatacaaaggatctggcgattgcgctcaaagcctcgaacgaggaggtcaaggaggttattctgcgcaatatgtcttcgagaatgcgcgaaaccatcgaaaccgatatccagtacctgcataatatcaggatgcgtgatgttgaggaagcgcagcagaagattgtcggcgtgatccgtcagcttgaggagagcggtgagattgtcatcgcccgcggaaaggacgatgagatcattgcttaaggtgattaagccgggtaatgccgtctgttctgacgacgttgtgctgattgcagatatgcccgcgccgccaaagccaaagccggttgacccgccggaccaggacaatcccgaagcattggcgccggagctggcgcaggagacaattgagaaggaaacggttcatactgccgaacaggaggcggagcttctttctatccggcgcgcccgcgaaaatgcggaagaaatttcgcagaaaattcttcgccgtgcccgtcaggaacgtgatgaaatgcttgaaaaggcgcgtgccgacgctgctttcttgaaagagcaggcagcgaaggagggacgggaaacagcctatgagcagatgaaggcaagcatcgacgattgtttgcagcaggtttccagcctgcttgatgatcttcagcttcgccagcgccaatttattcagaaatacagcgacggattgagcatgctggctgtggacattgctgaaaaggtgctcaacatgcgcattgtgcgtgatgacagcgaaatgattgagcttgtgcaccaggctgtttcctccgtcaagaacgcggattggatttctgttgaagtttcagataagatgcagggattgattgagcgcctcgaaacggaatttgcacagcaggcggccggagggccgcgcgtggacgtgatggcagttgacgcgccggtaggtacctgtgtattgcatacaccggaggaggttattgacgcatctgttcctgtgcagatcgaaaatgtacgggagctgttcggacagattaaataacgaaccggggaggtggggctttggctggagtggtggatattgcaccttatcgcagagcgatcaggttaaacgatttatatgcgcattatggaaaggttgaaaaaatcgtcggtatgatggtggaggcgacaggcgttacatgcaatatcggtgatgtctgcaacatccagattgacgcaaacaacagcattcttgccgaagcggtcgggctcaagggaaattctgtacagcttatgccgtatcaggacgttacaggcattggctttggcagcgtagtgatcccgacgggccaaagcctgacgctccacatgagtgatgagctgatcggccgcacggttgatgcgctgggtaatccaatcgacggtgggcctgcatttcaatcgggtgagagttattcaatcaacggaacgtattccaaccctatggaccgcccgccgattactgatgtgattgaaattggaattaaagcaatcgatggccttttgacaatcggaaaaggccagaggatggggattttcgcaggaagcggcgttggaaaaagtacattgatgggtatgatcgcccgcaatatcaaggcggacgttaatgtcatcgctctggtaggagaacgcggccgcgaggttgtcgagtttatcaaccgtgatctggggccggaaggcgtcaagcgttcggtgcttgttgtcgccacatccgatacgcctgcgatgatgcgttccaaatgtgcgttgaccgcgaccgcgattgcggaatattttcgcgatcagggcaaggacgtgctcctgatgatggattcattgacgcgcttttgcatggcgcagcgtgaaatcggattgagcgttggagagccgccggtcgcacgcggttatacgccttcaatttattcggcgcttcccaagcttctcgaacgttccggaaacttcgagcacggttccatcacgggcatttatacggtactcgtcgagggtgacgatacaaacgaaccaatttcagataccgtgcgcggtattgtggatggacatattgttctgtcgcgcaaggttgccatgaagaaccattatccggccatcgacgtacttgcgagtatcagtcgcttgatggccggcattgccacaccagagcataatttcgcggcaggcaggctgcgtgccatgctttcaatttatcaggaaaatcaggacctgatttccattggcgcctataaaggcggcagcaacccggagcttgacgaggcgatgcgccatattgatcagatcaacaagctgctccagcaggctgtcgatgtcaaagtcgattttaacgatactatccagatgatgttggatattataaagtaggcttgtgcagtcggagtgattgagtgaaggaggatatgtgaaaatgaagaaattcaaattcactttgggccggatgctcgattataaggaccagctgttggacgaggaaaaaaataagcttgcgctgctgcgcaaaaaaaagcaggagattgatgaccatattgaatcgctgctgcgggagcttgataaaatttcagtgacgatgcggcaggagcaggagcgtggaattacagcgttccaattgttgtcgtatgagtcgcaaaggaccaatattcgccgccagatcgagcagcttaaaaaggaacaggcactggcaaagctggaagtcaagcgtcaggtacaggtggttgtacaggcgacacaggaggtttcaaagctggataaactccaggataagcagcttgaagaatataggaagatggtgatgaaggcggaggagcttgaaatcgaggaattcgtctcgtcacggcgcattgtgacccagtcgcaggcgcaggaataaacgtataaaatccactgaaaggaggtgaaaacaagatgaatcaattggcaatacaggatgcagtcatgacaaacagcagtgcggtcaaagggctgcgggagctgtttggacagcaggcggccggctccgacgcgtttgcggcgctgatccagcaattgctcggcggagccggagatgaagaaaattttgcgatgctgatgcagcagatggacgcggttcaaaagcaggatgaggaggaaggcacaaatcttgctatgcagatgatggcggagctgttgctttcaggaaatccccaggcacaggagctgttgagccggatgggtattgagctgacgccggagcaggctgctgcggccggaaatgtcggccggcagaatatgctgattcctgcgccggtgcagcaggagcagcccaagggcgagcaggaggagccggttgtctttgaggtcgtttcagaaacacgccgggcgatgggacagccgcaggatggcaagagcgcggatatgtcgcttatgcagggccgcggaaatttccaaagcgcgatctatgaggcgcgtcaaaagctggcgagtacggcgagcgaacgcatgtccgagccgatcgatgtggatgctttgcaggcccaggtggatgcgcgtcggtttgaaccggctgtcaatgtccaaaaggcagagcaggcgccgcagccggaggcccgtaatattttggagcagttgaaaacgggcattcaggaaaactatgcggcaaacagggacgaatttgtcgtcaagctcaagccggatggccttggtgaaatcacagtcaagctggttcaaaaggaaaacagcattgcattgagtattctcgcgtcaagcccgcaggtggccaggctgatcagcaatgaagttgcggcactgcaaaatgcgctgcgtcccttgcaggccgaggtcacacagatttcggtggcgccgcaggccgcagaggctgccgcgcagtatgcagcgttcaatgaggatggatatcatcaccagcagttcggcggtcaggagcagtctcatgcatcacacagaggtgcgcggatggatgattcgatcgatgaaatttccatgcagccggaattgcttgtcgaggatgacaatctggatgtctacatttgatgaagggaggtcgggcgaattatgtcttcagtttcaggcgcgggcggctttcgggacgaatggatgaataatattatgaattcggacggaaagacaaacagcacgcagagtacaacacagacaggacaggtttggaacgccgtgttcgaggatgagaacgatatgggcgtttccgtggacgattttctcagcctgatggttgcgcagctacagaatcaggacttcatgaatccggtggacgacacacagtatgtcacacagctcgcgcagtttgcgacgatgtcgcagatgcaggagctagccgcaaacatgaagaacaattatgcgctttcgctcgttggtacaaacgtcacagccgccaaatttgcggtcagcggcgcgctgattaaggaaactgggccgatcagcaaggtatcgcttgttgataattcctaccagattacagtcaatggccagacgttctcgctgtcggagatcatggagatcaacaattctgaatcttccggttcgacaaacaataaaaacgaccagacagcatatcttgtctcactgatcggaaagaatgtaaccgtgaagcatgatggcgataccatcacgggaattgtcgaggaaatctccacagaggacggctacaaattgatgatcgacggcgagtggtattcgcttgacgaggtaaccggcgttgggtcggccgacaaggacgatgcggatggggaagattcgggcagcgctgaggaagcggccgagacgctttattttagagcgttttaaagtacccgggaaaggagtgggatgatggacagctacctgatgcaaagcaggctgtatatgccggttgttaccggtacgccggcggtgcggccagcatccccgcaaaaggaacaggctcctcaaagccaggagtcgtttaaaaagattcttgacgagcaggttgccaaaaccagcaatttgtccttttccaagcatgcggccgcacgtgtgcaggagcggagcatcacactcagccaggacagccttgcgaggctcgatgaaggtgtgcgaatcgcacgtgaaaagggaatggacgatacgctgattattgttgattcaacagcatttattgtcagcgtaaaaaacggcactgtgatcacaacgcttggcggaaatgatctgcgcggcagtgcgatcacaaatatcaatggaaccgtaattgtttgactggacctgatgggggtcaacgcgggctttgatcgattgataagcccgccggttccgaaaaaggagattttttgatatggttagatccatgtactctggcgtggcgggtatgaaatcccaccagcagcggatggacgtaattggtaacaatattgccaacgtcaatacatatggctttaaatcgagccgtgttaccttccgcgatatgttttatcagaatatccgcaacgcgtcggccggtacgtccacgcgcggcggtgtcagcccgtcggggatcggctacggctcccagattgcgagcatcgataagctgatgacacagtcgtcgatgacttcaaccggacagccgcttgactgcgccattacaggagacggcttcttccaggtacaggacagcgacggaaatatcttctatacgcgtgccggaatgctcgatattgaccaggcgacaggttatctggttgatctgaacggttattttgtactcggtacccaggggccggatgtcattggcaaagcgccgggcaacagcaaaattcaggtaaagctcgatcccctcgaggcagcagccggttccaagaccgaaaccatccagaatgtcgagtacatattgagcgccacaaactatacgacggccggaaacgttaatttcaacttctcgctcgacaacgagatgccgactggtcagaatatacgtgttgtggtagacggcaacagcatcgctgtcaaggtcaatccaaccgcacagtttgccagcttgtccgcatttatggacgaggttaacaaggcgattacagacgcgcgcggcggcgtggagcatccggctggacttttcacgatcacggccgatccagagccggccggaccgctcaccggtgagcaaattgttaacagcgacagaggaccgactggtggaaaaatcgtatttgatggcgctttgaagaccgggtatgctgttaaaagctacggttcggcattcagcgcgagcggaaacttgacgtttgaaatccagcgtacagcgccggcgaataatacgacggctccggacagtgcagattcccgctacacagtcaccgtgaccggtacgaatgccgcgggccaggcagttacttatacaatggctgatttgacctatgcgcagttgacgaattcagctggcgtacatctggtgaataatgctgccggtgcggacccgaatgatagctttgacctgcgtattccgtctagtttttatgaaaaaaatgacaacggtactcctgataatcctgctgatgacacttatacgtttccggccgcaggcacagcgcttggcactgcgacgccgcagacgccttccgggaatatcggtcttggcagcaaggatttcctgcttgagggcggcactgaaggcggtccgcagtcgctgatgaatctgaccggcatcgcaattggcgccgacggtatcatccgtgcgcagaacgccggaaaggatatcattgtcggccgtatcgatcttgcgaactttgataacccgcagggccttgaccaggcgggtagcagctacttcgctgcaaccgacaactccggcaaggccaaatatgccgttcctggtgaggatggtaccggcgcactaaaaaacagcacgttggagatgtccaatgttgatctttcgcaggagttttccgatatgatcgtgacacagaggggcttccaggcgaattcccgtttgattacggtatcggataccatgcttgaagaactgatcaatctgaaacgttaacttttgcaatttgccgcgtgccgaagggccggcccttcggcgcgcaggcaaacggatatgagctttcatatccgtttgcctgcgcgcgatcaacacgcatcgtatgtctgtttattgcggatggaaagaaaacatggaaagaaggaacgaaccatgatcgttgttaccaagctcaagggtgaaagatttgtcttgaattgtgatttaattgaaaccatttctgaaaatccagacacgacgatttccctgacaaatggggacctgtatattgtacgcgagtcgatgcaggaagtaattgacaaaaccattgattttaaacggaaaatctatcagaggttttgattattcccgtaataaagttataaagaggatgagacaaacgtatggattttttgtctgttttaggctggcttggcggcatagcagttattctattcggtattctttttgataaggatactggcggccttatatgggataaccttataaacttttttgacgctcccagtgttgcggttgtgctcggcggcgtgattgtcgccctgatggtgtccttcccattcagcattttcaaaaagattccacggcatctgaagattatcctttttcccacgaagtttgtgccgcaggattacatttcgcagattgtcgagcttgctactgaagcgcgcatcaacggattgctttctttggaaggtaagttgcaggatgacggtgacaaaaagaaggggaaaaaaagcgacccatttttgcgcaacagtatgatgctgattgtcgatgcggtagacccggaaaaggtcaaaacgcttttggagacagagcttgattacctcgatgaacgccatgcgcaggaccgtgccttttatgataaagcttcggcctatgcaccggccttcggtatgatcggtaccttgatgggtctaatcaacctgttgaaaagtcttgatgatcccgatgcgatcgccccggctatggcgttggcgctcgttacgaccttctatggtactattctttccaatctgatctttacgccgatttcaaataagctgcgcgttcgccatgaagaagaatatttgtgcaaaatgatcgtcgttgaaggtgttcaggcgattcaggcgggcgacaacccaaagtttattgaagaaaagctgacgcagctgattccaggattccttgcagccaagggcctttctaaaaagggcaaaaaaggtaaaaaagatgagtaaaggcggtatattgcatgaagaagaaagttaggccgccagaggataccggaacatggatgaatacatattccgatcttgttacactgctattgacgttttttgttttgctgtacagtatgtcgtctgtcgatgctgaaaaatgggaaatgattgtcaaagcattttcgaatcctggtgatgatacacagcaggtcgtcattggaaatgcgcaggatcagggcgatcagcttttgaccgccaccggcgatatgccgcctcccggcgacaaggagtcgttggagcggaccgatcaacagatgccggccaattttgatgaattgtatgaatatttaaagtcttatgcagcctctcagggcatggaggattctgttcaaatttccaagggagacggcagagtttatatccggttccagaataacctgttctttgcgccggacagcgcggcgattttggcggatgcatatcctctgctcgattttcttggcgattgtttgaatgcggttgatgatgaaattctgcttgtcaatatcaatggtcacacagcggctgttcccaatggtgaaacctatcaggtgtccgactggatgctttccagtgaacgcgcaagcaatattgcgatttatcttgatgataaaaaggatgtcgatccaaagaagctgcgtccgatgggatacggaaaaaatttcccagtcgcggacaacgatacgatcgcaggacgcgaggaaaatcgccgtgttgatattgtgattatcagcaatcagtcgagtttgacacagaatgatgcaatgtataaagagtttgagggcttgtttgatccgaccaagttccccgagtcgggcggcgttgatgatcttttgattccaagcgacccgctcttggatggtgaggcggcttcaagcgccatatccaataaccagacaacgcctacaccgctggatgtgtctggtacggatacggatgtcagtacaacaaacagttaggagcgaaacagatgccagagcaattatcacaagctcagatagacgcactgctgaagaaaatgagctccggtgaagtcgctgtcgaagaaaagcagaccatcaaagagtatgattttaaatcgcctaagaagttcacgaaagaacagctcaaggcaatggacggccttcatgagacgttttcgcggctgctctcctcatatttgtcagggattttgcgcataggatgcgatgtgcaggttctgcagattgacgaggaacgctattatgaatacaataacgcgctgcctgatacggctttgatcggtatcgtggggatggatccggagggggaggattattccgaggggacgatgatcattgacgtttcaacgacgatgggcttctacctagtggatcgtctgctcggcggctctggagacgatttcaatttcacacgtgattacaccgaaattgagatggcgatcatccacacaatttttaaggaaatcgtcggaaagctggaggattcctggaaaaacagcatcgaggtcaaaatgacgttggacagcatagaaacaaattcccgtctgcttcagatctttgcgccggaggatacggtcatcatcgtggtcatcaatattaaagcaggaaagctgaatgcgacgatgagtatctgtatgccggccgacaatatggaggaaattatcgacaagttcagcatgaagtactccaaatcgaatcgccgcacagatcctgaaaaagagcagatgcgcaaagaggtgctgttgcgcggcgtctgcgatacagaccttccaatcaaagcgacatttgaccagtttaagatggatctaaaggatattttgcagttgcagccatcagatatcattcctctgaacaaaaaaattacggatgatatccaggtaacgctggatggcctgccgtggtttacggcaaagcttggtgagacgaaaaagaaaaaagcgatcaagctcaataagatcatagtagaaaccaggaaatgagggaaaccaatgagtgaagaattgcttcagaaggaagtgtctgtgccgtccattagcatgatggaacaggacgcgatcggcgaagtgctgaatatcagcatgggttcgtccgcgactgcggttagcagcctgttggatcgacaggttaatatttccacaccatctgtcagtgtgcgtgaatttcatacgcttgattacagtgcgatggaaccggcgctgatcgttaaaattgaatatgtggaaggtatctcaggaaacaatgtgatggttttccgtcagcgtgatatccagattattttgaacctgttaatgggcaacgacgatccgccgtctgatgactttgagtttgatgagttaagcatgagcgcggcctgcgaggttatgaaccagatgatgggcgcggcggcaactgctctttcagaatttttaaaccgtgtcgtcaatatttcaacgccgaccgcgtctgttgtgacctcagaggattcttaccgcgatgcaatcggtgttcaggagggcgatgagatcgtcgccgtttccttccatatcgatatccaggatgttatgaacagcgattttgtcagcatcctgacatgcagcttggccaaagagattgtcgaacagatcatgggcaataatcaggagtccctggaaaatatccatgctccggcgcagccgccagcggccgttgccgcacaggaacagtctgccacatcaccacagtcggccatgcagccgccagctgccgccgctgcaccgcagccgcctgtgacacaagccgctccccctcagccggccatgcagcagccggcgccggctgctatggatatgactgcgcagcagcaagcgatgcagcaggtcggaatgcagcccgcatatggaatgccgccatatggccagatgccgtatggttatccgatgtatccaatgccgccatatccgcagcaggcttatggtatgcaggaaccgcagccggctacacagaagccaatcaatgtacaaaatacacaatttccgcaatttacagttcaacagacagattcgcccacatcaaacgccaatatggatctgttgatgggtgtttcgcttgatgtctctgttgagattggtcaaacaaagcggaagattaaggatatcattgattttggacagggaacggttattgaactgaacaaacaggcgggagcgcctgttgatatcgttgtaaatggccgcctgcttgcacgtggcgacgttgtagtgattgatgataactttggcgtgcggattaccgagattgtcggcacaaaggaattaatggagagtctgaaagaagatgccgtttaagcggtttctgatttatcaataacatttgattaaaaggagttttcgaatatgggtatggacagtaaaattatgttggttgatgacgctgcgttcatgcgtatgaccatcaaaaactgcctgacaaaagcggggtatacaaatttgattgaagccggagacggtgcgcaggctgttgatacatttgcaaaagagcatcctgatcttgtgattatggatattacaatgccgaataaggatggaattcaggcgcttcaggagatcaaggcgatcgatggcggcgcaaaggttgtcatgtgctctgcgatgggacaggaagcgatggttgtccaggcgattcagtttggcgcgcttgactttattgtgaagccttttaagccggaccgtattttgcagactgtttcaaaaattctgggataaccggagcgttacatggaaactgccaaccagttacaaagtgttctgtccatgatcggcgcattggtcatcttcatattgatcttggtacttgcatatttcgctacaaagtatatcggccggcggtatggaaccaccggagccagtggcggccggtatgtcgaggtattggaacgggttgcttttggcccggatcgggcgttgtttgttgtcagggcggggggaaagattcttttgcttggcgcaacagcgcatcatgttgagctgattacagagcttgacgcttccctctttccggagcggtctgatgcgccggaaacgcataccgatttttcagtgatgcttcaggcgttcttaaaaaatggacgcggcgcaaagtcaaaggatgagaaggataaaacagatggataaagtgaaacgggaaaaacgggcgctgaaaaagcatctcaggcgctttttactttcatcgttgatcacggggctgctattgcttgtatgctgcacaatcaccgcacatgcggcgccgatggtgacggtggatcttggaagcggcgatgcgtcaggaaacgcatttggccttatcgacatgctgtttgttgtgacactgctcgcccttgctccatcgatcctgatcatgatgacaagtttcacacgtatcattattgtgctgtcgtttctgcggaacgcactcggcattcagcaaacgcctccgaatcaggtgcttattggcctcgcgttgtttttaacgctgtttatcatgtttcctgtgattaaccaaatcaatgaggaggcttatcagccttaccgtcaaggtcaaattactcaagaggaggcagtaacacgtgggatcaggccgttgaaggaatttatgatccgccaaacacgtaccgatgacgtcaacctgttcctttccattgcaaatgacaagcggccgcccgaacaggcgatcaccattccggaggatttgacggaactggggatggagatcgtaatcccggcctttattaccagcgagctaaagcaggcgtttatgatcggctttttgctgttcatcccgtttttgattatcgatatggtggtatcaagcacattgatgtccatgggtatggtgatgcttccgccatctatgatctctctgccctttaaaatcatgatgtttgttatggtagacggatggggactactgcttggaaatctcgtgcgtggtttcagatgaaaatagccggtaaggagggggacgaatgacgcaggaacaggtgatgagtattttccaacaggcgatcatactggcttttaagctggcgggaccgctgttggccgtcagcatcatcatcggtcttgtgatcgcaatattccaagctgcgacacagatccatgaacaaaccttgacctttgtccccaaaatcgtggcaattgcgctgatgatgctgttgctgggaccatggatgatcacaatgctctcggatttcatgcaaaacctgtttggcatgattccaacgctttaacctatgcttgattctgtgatggcgggactgcccgcatatatgcttgtgtttgtacggatggccgccatgattgggacgaatccgcttttgtcgcggcgcaatgtgcctgccgctgtacgcgcagggctgactgcgctgttgacgtttctgattgctccaggtctgacagttgcgccaatggaccaaatgacgcttgtattggcgatgctcaaggagtttttggttggctttgcctgcggttatgtatttcaaattttttattatatgcttttttttgcgggcgacgtgatggatatgcagtttggcctgtcgatggctaaggtgtttgatcccggcacgaatatgcaggtatctgtttccggcaattttctgaatattttgttttcactgtttatctttgcaacaaacagccatttgttgcttgtgcgtatttttgcgacttcctttcagatcgttccggcgggatttacgcctttttcaccgcatgtctccggatatatagctgatctttttatcgaggcgttttcgcttgcgcttcgcttggctctgccctttatcgcagtggagtttgtgctggaagtatcgctcggtattctgatgaagctgatcccgcagattcatgtctttgtaatcaattttcaactcaaggtttttttaagcctggtgatgctcctgacctttgcggctccgctttcatcatttctggacaattatatgaattacatgcttgaatgcattcaaaaggttctgtggacctttacaggctgatataacgtgatgtcgaaaaggggggatacggtacggcgggagagaaaacagagaaggcaacacccaaacgaagaaaggacgaacgaaaaaaaggtaatgttcttcaaagccgtgagattgtcgttgttttttcgttgataacgactttttatggatttcaactgctgtggccgctctcctatggaacgcttaaacgtgccctgacatcgtttattggcatgacctcgtcgatcgaccgcattggtatgcaggaaatccgcatctattttatgcagggttgcatattttttgtgctttctgcattgccgctattgttgatctgcggtttggttgtagttatctgtacggtagcacagacacgcggtctttttaccatgaaggctgccgctccgaaatttggcagaatgaatcccctacagggtattaaaaagatgttttctctgcgaggggtcgtcgagcttttaaaatcgattgttaagattatcatcttaggttatatcatttataattctcttggcgaacagttctttttcatgcctcgcctgatggatatgagtcttgaacaggcgttggcttttacaggaaacatcattcttgatattgctaaaacggcagcgattgtaatggtgtttgtcgcgggatttgattatctctaccagtggtgggacttcgaaaagaatctgcgcatgagcaagcaggaattaaaggaagaatttaaacagaccgaaggcgacccgcaggtgaaaggaaaaattaaggaacgccaacagcagcaggcgcgtcagcgtatgatgcagaacgttccaaatgcggatgtcgtcatccgaaacccgacgcactatgccgtggcgattcaatataacccgcatcagaacaatgcgcctgttgtcattgcaaagggcatggacagcttggccttgcggattgtcaaggttgcacaggagcatgacatcataacaatggaaaataagccgctggcacgcggtctctatgaaacggttgacctggatcgggaaataccggaacagttttaccagccggttgccgaggtgctggcgttcgtttataacttgaagaaaaaggatttgaagtagatttgaagctttttaacaatgcggtttcggcgtttgtcatcgccgtaatagctttgctgatcgtcccgcttccgacgtggctgttggactttatgttcatcgccaatctgacgatctccttcgtgatcctgctcacgaccatgtacatcagggaatcgctggaattttcgatctacccctcgatgcttctgattaccacgctgttcagactggcgctgaatgtttcctccactcgaaagattttgacgaatggcggttacgccggcgaggttgtcaaaacgttcggtgagttcgtgattcagggtgatgtagtcgttggtctggtgattttcctgatcatcgttttggttcagtttattgttatcaccaagggttccgagcgtgtcgccgaggtttccgcgcgcttcacgctcgatgcgatgcccggcaagcagatggcgattgacgccgacctcagctccggcctgatagacgaggcgcaggcgcgcatccgccgttcaaaaattcagcgtgaagccgactttttcggcgctatggacggtgctacaaagtttgttaagggcgacgcaatcatgtcgcttattacgaccctgatcaacttagttggcggcgtcatcgtcggttttgtcaccggagtcggcgattttgcacagattatggacatctattcgaccgctacggtgggcgatggattgatgtcgcagattcctgcgctgctgatttcagtggcgacaggcatgatcgttacccgttccgcatcagaatcgaaccttaacgaggatgttgccaaacagctcttttctcagccgatggtgcttattatggcttccatcgcgatgtttatgacaaccttcattggattccctaaaaagcaagtcattgtgatgtcggtgctgttgatggcgcttggtattctgcttcagcgccgcggttcgccggtggtacagccggagggggccatcgcagaagggggcgtgccggcgccggttgcagaggttacaaacgaagcttcgttttataaggatatcaacaatgtttacggcttgctcaatgtcgatcaagtctctatggaatttggttacagtttgattccgcttgttgatgaaaacagcggcggcagctttgttgatcgtgttgttatgttccgcaagcagtttgcacaggaaatgggtatggtattcccatcggtccgtttgaaggacagcgggcagctcaatccaaaccaatatgccatcaatatcaaaggtgagcaggtcgcgcagggcgaggtgcttgtcgaccattatctggcgctgataccggaaaatggggaggattctgtcgacggtattgagacagtcgagccggcctttggcatccaggcaaaatggatcagtgaggataagcgtgttcaggctgaactggccggttatacactcatcgatccgacctcagtcattattacgcatctgtcggaggtcgtcaaggcacatgcgtatgagctgttgaaccgtcaggaggtcaataatctgcttgccaatctgcgtaagacaaacgaggcgattgtcaacgatacggttccagcgattgtatcgattggcagcctgcaaaaaattctgtgcaatctcctgcgtgaagggattccgatccgtgatacggaaacaattcttgaaacgctcgctgactatggcgcgacagtcaaggatatcgacatgttgacggaatatgttcgccagtcgctgcgccgcacgattacgcatcgctttgccgaggcggggcagctcaaggtgatcagccttgacgcaaacattgaaaatcagattatgggcgctgtcaaaaaggtggagagcggctcttatcttgcgctcgatccgcagacaattcaaaatattatcactgcgacaacgcgggaaatcgacaagatcaaggatctggttcaggttcccattatccttacatcaccgattgtccgcgtctactttaaaaagctggttgatcaattctacctgaatacggtggtgctgtctttcagcgaaattgattccgacgcaaaaatacaggcgttgggcaatatcacgatttaagccttttcgacacaaggcggcgcaggccgtcaaaaaatctgacaggcggcttttattcgggctgcaagagcagtttatgcgccggtaaaagcccgctgtgaagggagtgttgaaaactgaacactgcgttgcaggaggagcggcagatcgaagaaaatccggaagaactgatgcgcctttataaggaaaccggctcccaggagctgcgcaacaggatcgtgatgcattacagctacatagcaaagtcggttgcgatcgaaatgaacaatatgttccataaatatgcgacgatcgaggagatggtcaaccagggggtgatcgccctgattgacagtgttgaccggttcgatccggatcacggcgtcaagttttcgacctatgcgtttacaaaggtaaagggtgcgattattgattatgtgcgtaagcaggattggctgccccgccgcgtccgtcacaacgcgatccgcgtcaacaacgcgtacaatgacctgcccatgaagctgggacgcaacccgacgcgttccgagatggctaaacagctcgatatgagcgaacgggaatttgaccagtgtatctatgagatgtcgggggaaagcatattttcttatgagtcgttgctggccgacggaccgcaaaatcagaatatgctgtggccgatggagggcgaaatcgtcaaccctgaaggatgcgttgatgccaaggagctgagggaacagcttggcatggcgattgacagcttgaatgaacaggaacggcatgtgctgtcgctttattactatgagaatctgacaatgaaggagataggcggcgtgctcggtgtcagcgagcagcgcatcggtcagatcaatcggaagctgattcaaaaattgcgtaataagcttgaacaatatatgaaaggttgaatggattatgttgagaggattttatacagcggcatcgggcgtcttaatgcaggaacgcacgctcaacgttctcacgaataaccttgtgaacgcgcggacaccgggctttcgcgcttcacgtgttgtcagtacgacatttgaggatgaatatctcgtgcgcctggaaaagggtgcgagcggcgcaattggcacaggcgcgccggtgcggatcgtatcggatgttccaactctgtttgatccaagctctttggaggagacaggacgcccttatgatctcgcaatcaatggtgaaggcttttttaatatattgacgaccgacgcgcagggcaatgagcgccagtatttgaccagaaacggcaacttcgatgttgacgaggaagggatgctggtgctgcgcggccatggacaggtgctgggagaaaaaggacctattcagcttgatacggctaattttactgtcgattacaacggtgatatttataatgaaaaaggcaagctggtcgataaggttcttgtcacagtcccgccgcaggacgcggagcttgaggtggatgcaaacggaatgtatacggcgcaggacatgacggcaaacacacaggtcggcgataatgtcatgattgttcagggttggacagagcgctccaacatcgatccaaaccgcgaaatggcgcttgtgatggaagcgcaaaggaccttccaggcgtgcagttcggccttgcagatactggacaaaatcaaccagaagtcagccacacagatcgcggcgctttaattgaaataaatatataaaaagaggtacggcgctatgaatattgctttttataatggtgtctccggattggttgcctaccagcaggagatggaccttgtttcaaacaacgtggccaatgtcaatacagtcggatataaaccgtcgcgggcttccttcagcgaccttttatacacgcagatgtggaccaatacagatgcgcttgtgaatgcgggcggcgacgctggcgcacaggatacggccgatgaaaatggagtcggcggcatgaccgacgcggacggtatccatatgcaggggcatggcgtgcgccttgcatattcggatttggtatttcgccagggcaatctgctgcaaacggagcatccgcttgatatggcgatcaagggcgatggattttttgcggttgaacgcgccaacggtacgactgaatatacgcgcaatggcgcgtttgatatcagtatagaagggaaatccggttaccttgtcacgtcggatggatcctatgtgcttgatgcaagcggcaagcgcatcaagctggaccggggggatgacgatcagtttgatctgacaaaccttcaggacgaagtcggcgtctatattttcccgaatccctatggattggaacccaatacgggcggcttccgtgaaacgcctatttccgggacgcctacggtcataaaagcgtcttcgcgcgcgtcgcgtccgtataccattgtaacaggaatgctggagcagtccgcggttgatctgtcggaagaaatggcaaatatcatcgtcagccaaagggcgtttcagttcagcgccaagatggtgcagaccgcggatgaaatcgaagacacggtcaacaacttgagataacaggaggttttcaatggcgattcgtgattatggtgaattagacgatatccatcttgatgtactgcgcgaaatcgggaatatcggctccgggaacgcggccacctctctgtcggatatgcttgcgcgcagggtagatattgctgtacccacaatcaaaattcttgattatgaatcggttacagaggagcttggcgggccggaaaccatgatcattggtatgctgctttttttagagggcgatgtgaatggcatgattatgtttctgctccagaaagagtttgcccatataactttgaacgcgctgcttggcgagtcgttggaaagctttgcggagcttggagaaatggaatattcagctatgaaagaagtcgccaacattatggccggttcctatgtgaacgcaatctcatccatgacaggacttaacatcaatatttcggtgccggatgtcagcatcgatatgctgggtgcgattatcagcgtgcctgcaatctattatgcaaatatcagcgataaaattatttttatcggcgatgcgttcaacagcgatgaggaacaggctgccagtcatatcctgatgattccggatatggagtcccttgagaaaataatgacgaatctggggatagatttatgagtaagaccatcacggtaggcatatccgacctgaatatagcgaaggcgccggatatcctggtgacgtatgccctggggtcctgtgtagggatctgtttgtatgatccgatggtaaaactggcgggattatctcatattatgcttccttccagcaatctcaacaacgatccgaagcaggcatatcggtttgcagatacggcaattgtcttgcttgtaaaaaagatggaaatggccggcgcccggtctgcgcggatgaaagccaaaattgccggcggagcgcaaatgtttgcggcaatcactaattcttcaatttccaatatcggtcagcgcaatatcgctgcggtaaaggagactctggccaaattgcgcatcccgatcattgcggacgatacgggaaaaaattatggccgcacgctttactttaatgcagcggatggtacgatgcgtatcaaatcggttaatagaggggaatgggtctggtagcggctcgaacgttgccaagtgagtattcagggagaatgagagagacgtcaagcatccgaaagaaaattgtggtgaacacagtttcaatggtcatgattttatcgattgtatttctttgcattttatttctgacatcacgcattatgacgaatttgattttgctggatgtgatgcagccactggtgcggactgcttcacaggcagtcgaggccaatctgcatgtcttgtctgatcgggtttttatgatttctgacaaccgggtttttacagaagccggcacgacaaaagctgaaaaacaggctttattggagaatgcggcttcaggaatcgaatttatatctctgtcgctttatacgcccgatggaaagctttacacatcctatggcgatggtacgccggatatttctcagcgtgagatttatcagtatatgaaggaaacgggcggcttggttgttgatgatacatcggtcaatgggggaaatttgcaggttgcaatcggtacccctgtcaccgacgctgatggggcggtaacatactatttggttggcaattataaatacgatgtgctgaatgatgttgttagcaacattaatatcggctatacaggccgtgccttcatgttcaatcaagatggtgttttgatggcgcattctgatgcagagaaggtcagatcgcaggaaaacgtatatacgacgtattcaggcggcgacaagcttcagagcctttttgatcgtgctttaacaggtgaaatcggcgcgtcacgcgtccgtattgatggaaaggacagttacatgacgtttgcccctgtgcgcggcaccaattggtcgattgcaatcgcggttccgcagtcggagtttatgggggcgggaaacggcgcgcttcagattacattgttgattacagtggcaatgctgctgatattggttttgcgcatcagaggcttttccggccgaattgctcgtgcgcttggaaatgtgacagaccggattcagcttttgtcgcaaggggatcttaccagttcgaccgatgtagtcaaaacgaatgacgaggtggagacgctttcacttgcgttgcgtgaaacgatcggggatatcaatggttacctgtctgaattacgtgacgcactcacacaaatttccaatggaaaccttgatatccaaattcaaggcaagtttcagggcgattttgttgtcatgaaggagtctctcgacaaaattatatccttcctgaacaacgccatgcatgaattacaggtcgcttcggagcagcttttgcttgcttcgcgtggcgtttctgattctgcgcagactgtgaatagctcgtccgaaacgcaggcgcattctgttatgcggcttaaagcggaatcagagacaatactacagaatgtcaatgcggttaatgaccatgcacagcaggcggaagctttgatgaataaagtgaaagttcagcttgacagcggcgatcagcagatgaagcagatgctgcaatcgatggatcagattaatcagaatgcgcatgaaattgggaaaatttctaaattaatggaggatattgcgtttcaaaccaatattcttgcgcttaatgcgtccgtagaagcggccagggctggcgctgccggtaaaggtttctccgtggttgcacaggaggtacgcaacttggcggaaaaaagttcggaatcagcgcagaaggcgacgcagatgctcgagcattcacaggagcaggttgttgaaggttatacatatgcgcagcagactgccaaaacgatggcagatattgcggatatttcccgcgatgtttcccaaattatggacggccttgtcgattttgtacaggaacaaaagactgcgttggatggcatggcggaggatatcggcgcgatttccgatattggggagcataacttgtctgccagtgagcaggctgccgctgccagtcatgagatgatgcagcaggcacaggctttgcaggatatcgcgggacggtttaatcttagacagacgcagagcgccgaacaaatggaggaatcaatatgctgaaaaggatagtgccggttttattggccgcagcgatgattctatctttgggcggttgcggcaaacgcactgattcattaaaggatggttattatactgcgcaggcagcggaatataataacggctggaaggaatttgtaacgctttgcatcagcaatggagaggttgtatcagtggaatacaatgcaaaaaatgcaagcggctatattaaatcgtgggatatggcatatatgcgccgaatgaacagcattgtcggcacgtatccgaatcaatatacacgcaaatatgcagccgattttctgcaaaccggcgatgtcaaccagattgacgcgatcgcaggtgcgtccacatcgtataaatcttttataaagctgctttcttccgcattggaaaatgcaaaggcgggcaattccgaggttgccattgtatcgactgatacgggcggttgagccgaaaatagagagaaaacccggccttgtgccgggttttctctctatttaactggatggggacacgttttatgggacgattttgaggagacggtatgcgttgaggccctgtttttgatcatcagaataatacctgaaacaattgggacaaacacacagtaggtcaaaacagtgcgcagttgctccccagttagaggaaccgcacggaaaatactgcccaatacagggttgtagatagccaaatacattaaaattgccgatacagccactgcaccaaccaatttaagattattcagcgggttgatggaaaacagccctttggtttcgcttttgcattcaaaaacatgaatcaattgcattaagacaagtgcgagcagcgcaccggtacgggcggtcaaaagatctccactggaacggatcagggaaacaaatacgccaagtgtgcataagccgatcaatagtcctcgaatcacgatcgtgaatccaagcccattggaaaagacggattcattggcacggcgtggacgctgccgcatcacatccttatcaggcggttccagaccaagcgcaatggcaggcaggccatctgtggcgagattgacaagcaagatctgaatgggcaggagcggtaccggcattcccatcagcatggcaaagaacatggttacaacctcgccgatgttgcaggaaaacagatatcgaatgaatttgcggatattccggtaaattacgcgcccttcctcgactgctgcgacaagggttgcaaagttgtcgtcgagcaatatgacagatgaagcctccttggtaacatctgtgccagtgattcccatagaaacaccgatatcagcttccttgacagccggcgcatcgttgacgccgtcgcctgtcattgcaacagtgtgcccctgttttttaagcgcacgcacgatccgcagcttatgggccggtgtaacgcgtgcaaatacagaaatattggaaatcatacgcgtaagtgcttcatcgcttgttttatcgagttcacggccggtcataatccggtcgccaggctgataaatcgtcagctcctcagcaatggcccgtgctgtaaccgcatgatcgcctgtaatcataactgggcggatcccggcttcacggcattttataaccgcatcgaaggcttctttgcgtggcggatcgatcattccagccataccagtgaagatcagacgttcctcccgtatatcgcctgcgctgtcggcctcgcgataagcgaagccgagtacacgcagcgcgcgccgtgcgagcgcatcgttttgttgagaaatctgtgattttatggctggggtgagaagtgaaacgccgtttttggacagataatgcgtacaccggtccagcaggagatcgggagctccctttgtgaacaaaagatatttcccatccttacgccgcacacagacgctcatcattttacgcgccgaatcaaaaggaagctctttaactggctcataaggaagctgttttttgaaaacgcccgatttggccgctgcgatgagcagggctgcttctgtcggctcgccatccgtcgtaaaggcgtcctttcggcctgccggggtatcgagcagggcattgttgcaaagaacagcgatatcaaggagcatagctgaacaaggctcgctggaggcgcgtttcccaatttctgtttcgccggaggcggtccagaggaccttaacagtcatacggttttctgtcagggtaccggttttatcagagcagatgacatcggcgcagccaagcgtttcgaccgcatgcagacggcgaatcaaggctttgcgcttgaccatgcgtccgacagaaagcgcaagcgcgatggtaacgacagcgggaagtccctccgggattgcggcgacggcaagggaaattccggtgagcagcatgttgaagggatcttcgccgcgtaaaataccagtcactgcaacaacaagacagatcactaaacaggcgattccgattattttccccatatgtgcgagccgtttttgcagcggcgttggctgtacctctatggtgccaagcatatctgcaattttgcccatttcagtcgccccacccgtttcggttgcgcggcaaacggcgcgcccgcgcgtcactgtagcccccatatagacacgattagccttctgcggcgcatcgggatttggggccgcatatttttcaaccccgattgattcaccgctgagcatggattcatcgcagcttaaactatcgccgccaagcacacaaccgtcggcgggaatccggtcgccagcctttagacaaaatatatcgccaggtacaaccatgctggccggtatactttggatttgtccgtcgcggattacggctgcatttggagcagacagttccccaagcttttcaagcgttcgttctgtgcgatattcctgaaagaatccgagaagtgcatttacaaatacgattgcaatgatggtcatcgcttctgtatattcgcccatcagtgcggaaacgacggttgctgccaagagaatcataatcatggcgtcgcggaactgacctgcgaacaatttaagcgcacttgcttttttgccgcttctgatcttattttccccatgctccaaaaggcgtttttcggcctgccgggccgtcagtccctggtattcctccatcatgtacgttcaaccctttccgcatgaatcgcgcggtctttgtccgcgctgtcccccgcggtttacgcgggtgctcccttcatatttattctgtggtaaaccaggatatgtcgggacaaagagcagaaggagggccgcgtctgagcgcggccctccttctgcttttggggacaggggtgctgttattgtgtaatcagttcttcctgggaaagatcgggatgggtatttccgttcttggtgtcctcctcttttttatattccttatgcggccgtccgcggaacagcagatagaaggtcggcagcaggagaagcgtcagaatggtggaagctgtcaaaccgccgatgattacaactgccattccctgcatagcctcggaaccttcgccgattccaaggcccatcggaatcattgataaaaccgttgtcagggtcgtcatcagaatcggacgcagacggctgcggccggcatagacaagagccgtttcggcgtccatactggatcggtattggtttgccgtatcgataaacaggataccgttattgataactgtaccaacaagcatcaaaaatccaatcaaggacggcatactcattgtaacacccgacaacagcatcaagccaaacgaaccaatcagagagaatggaatacaaatcataacgatgattgagaatctgcacgattcaaattgcatggccatgaccataaaaacgaggaagacagccgttgcaatcgcaccgaataatgcgccaaactcctccatcatctgttcatcggcttgattctgtgtgacagccacgccttctggcagttcaagctctgcgaccgcctgtttaatttcttcgccggctgtcagagccgaggctgtcgtaggctgaccgctgattgtgacaatgtattgattgtttttacgctggatgctttgcggagcgttggaatattcgattgatgcgatatctagcagcgggacctgtttgccgcttggagaagtcaaaatcaacccggagagatcagataccgtttggaaacgttccttgggaaactcgatgcgaatgtcatattcacgtccatcgcggtccatagtggccggagaggtaccggataccatgttgtatacggttccaaccacctgctgaggcgtcatgccgaccgcggtcgccttaatggggtcgacaacaatctcagcctgtggattgcccgaagtgagggttgaggatacgcggacaatattgggattctgtcccatcactgcttcaacgtcctttgacgcttcacgcagcaaatcgagatcgttgccctggaggttaacatcgacagatcctccggaagaaaagctcatcatgctctgtgcgctgatgctgatatcacagttgggaatatcctttgtctgttcgcgccattcatcgatccactcgtttgtgctgcgttcacggtctgctttcagataaacagtcagagaaccgctttcgtttccagtgctggtcattgcgccgccgccggcagtcaagtaatagcgttcaacgtcggtggactcttgaaccatggattccaattgcgtcataagcgcatccactttttccagcttgaggcctggctttgtctctacggaaatcgaaatggtaccctggtcaatatccggcatgagctgaaaatgaatgaacggaagaagcataaatgacccgacaagcagtccgactgagataagcactacaagcagcttatgcctgaacgtttttttcaggaaatttccgtatgcaatcgttatcttattcaggacacggttgacatgggaatcctccttctcctttggcgcgagccggtaaaacaggagtggaacaatggtaagcgccgagatcagcgaagcggtcagggaaaagacaattgtaaagccaagctgacggaacatctgtccggaaagcccctccataatgcttatgggcaggaataccacgacggtcgtaagcgtagacgctgcgacggacgaggtaacaatccgcgcgccttcgatggctgcgtcacggaaagtcaaattgcgttcccgcctttggaagcagctttccagaaccacgattgagttatctaccatcataccgacgccgatgacaaggccgcccaatgaaacaatattgaaagaaaatccaaaggcgttcatcaggatcagcgttgtcaatacggaaacagggatagaactgccaacgattagagaagctttccagtcgccgaagaagataaacagtacgatcatacagaggatgatagcggaaatcagtgttttgataacactgttgaccgaactgcggatactgtcgctcgtatcattgataacggacaattcgacgcccatattgcgcgcgttgatctgttccattgttttgacgacagcttctgtaacctcgatggtacctgcgctctgacgctttttaatgccgagactgacggtttcattgccattataccggctgatagaatctgcgtcagcagttgcgtcgtagatatgtgcgacatcggacagatggattacctgaccggaacgcagcgtgatcggaatatttccgagactctcgacggtatcatagctgacgccgccgcgcaacgacaggctttgatcgccgcggtcaatgtcgccgaccgggattgaaaaatcagcagcgccgatgaaactgacaatcgtgctcatatccaggccatattgtttaaggcgctgctcatcaagctcaacgctgatataattttcctgtccgccggaaacatcgaccgatgcgacgccgccaagcttttcaaactccggcttaatctcctcatcgatataagaaagcagatcgatatctccagtggcgcgcgcggacagcgtaattgcgctcatcgaattcagatccatctcaatgatgattggatcctgcgcatcgtccggcagggcgccgctgtacatattcagcttttcctgcaaatccatgtgcgcgacatccatattggtgccgtattcaagctgaagaaccatcaaagagacgctgtcctgcgacacagattggatcgttttgataccgttaagcgtggatacagaggactccaactggctggtaacgaggtcctcgacctcctggggaccggcgccaggatatgtcgtcataacaagcagaaccggcatttccatctcgggcatcagctcaagcggagcgcctgtgatcgccgagaaaccaaatacaatcaacgccaggatgatcataaccatcgagacggggcgttttagtacaagctttgtcagattcatatggcgttacccctccgaggaagcttccgcgctttgtgacgggacaacagcggaggaatcagacgtggatgtgcctgtctgtgaagcgggagaatcgtcagcggcagacgccgctgcctcagacgcaggctcctgcggcgatacggtttcatttgtgccgcgcaccttggctccatcggtcagatttgcattccaggagacgatgacctgatcgctcgaagtcaaaccggagagaacctctaccgtttcctcattggaaagacctgttacaatcggcgtgcgtacagccgtaccatccacattgagataaacataagcctccccgtcctcataataaatgttttcctgtgggagcagaaggctttgctgcgccttgcccgtggtggcagtgaccttgacggataaaccggtctgaagcatcccgtcgtcggagttgatctgtgcctttaccttaaacaaaccggtttgcggatcaaccattgtcccgatctctgcgatgctgccggtataacttttctgaccattttcaatagtcacagaatctcccacagccatttgttcgacagcgcccgacggaacatagaaggtcgtcataatggtggatttgttcgagagcgtatatgctacagagcttggcgaagcaagcgactgttccgaaatattcttttgctcgatgacgccatcgatcggggcataaatcttgtatttatccagtgtagacgcgctttgctccaacgaaagctccgcggatttcaaatcggcctccatggctcgctgtgtatcctccagagaaccgccaagcaaaaggttatagttgttgagcgcctgctcatagtttgtctgcgcgttcttgtatgcgttacgcagatcgcgcgcctcgctgtcctcgctgtcctccagatcgttgacagcggagcggtacatgctgtaatcactttctgcctgagtccaggctttgtacagttcttctttttccttttggtcgtcgcctgtataatttttatacgcttcttccgcggccttcattttttgttcggcttcatcgcggcgcttttcagccataatcaaactgtcgtcatagccgtcgttgtaatctttcagcttcaggcgggtattgttcaggttctgctgcgcagcgtccacctgcgcttttgccgctagaactcttgattcatatccgctgccaagcgttgtatcagcggaaatcatacgctgctcataacctgcctgagccattctgtaagcaagggccgcgtcactgtcgtctatttcaaacagcaggtcgccctttttgacggtctgcccgacctcggcatatgtatgtaagaccgttccgcccactttcggtatcacactgacctgttcatccggctcgatggtaccgataaactctgtcgtaagggccaaatcgccgatttggggcgtctgcgtttcaaccgcaatgctttcatcctgcaccggcgcggttgcttgctcaactttggtctggcaaccggctgcggacaataagatcatagcagctaacaggcaggccaataaacgtctgccataaaatttggacgttttttccaatggtgttacctccaatatgtaagattatccaaaaatacaacgtgttaatcatatcgtgtttatatgaactttttttgaactaagcccgaggttcagcagggaagactggaaaattaatcatttattcataaagcttcgatataatacgcataaaggtatgataggggggcgggaaatgttcagtatattggttgcggaggatgattacagcctgcgtgagttgatgagcgattttttgtcggataatggctaccaggtgtaccgtgcaaaagatggcgcggaagctcttattcagatagaacgctcgcatattgatctgatgatttgcgacattatgatgccggagcttgacggttacgggctgacaagggagcttcgggaggcgggatttgacctgcccgtgatcatggtgactgcgcgcgagacgctcgaggacaagcatatgggctttttagcgggcacagatgattatatggtaaagccgattgattttgaggagttgctgtggcgtgtcagcgcacttctgcgccgtgcccagattgccagcggccacacactggaaattggtgggataaagcttgattatgatgctctttccgttactacggagcaaggtacggatgtactgcctaaaaaagagttccaacttttgttcaaactgctaaatacaccaggaaaaacctttacacggcagcagttgatggatgatatatgggggcttgattccgatgccgacgagcggacagtcgatgtacatatcaaacgcctgcgcgaaaaattcggcggcttttcgcagtttaagattgtgacagtgcgcgggctgggataccgtgcggagaaactgatatgaaacaaacttgttcgcagagactcagatggcttcattcgctccagtttaagtatatggttactctgttcgttatcgtgttcattgcatgtgcgatcacttatatgatcatgtttatgagcgtttgggggcaggtacgccatgctgcggaggaacagcttcagtcgataactgattttctaaccagtgtaatggaacggtcgaatatgcctgtaaatgaagtgattgatttgctccagccgagggtagattcaatcgggctggcaaaaacagaagaagcccttccggctggatttcggctcgatacgcctttagagccgaatcaaacgagattgaccaggcttgaaagcaatggaattgccggtgtttttcgtacagccgacggatatatctggttgtctgcaaaaaccgattccatgcgtgccagatggattcatctgttggttttgcagacgttgatcatctgcgccggcatcgcgagcgcgggcgtgtttttggcagttcgccattccacacgtccattgcgcgaattgaatgcagcgatcaggcatgtcgcgcgcggcgattttgaggtgcgcgtcgattaccgcggccgtgacgagatgggcgtcgtcgtacagaattttaactggatggttggggagcttcgaaatattgaatatttgcggaaggattttgtcagcagcgtttcgcacgagttcaaaacgccagtttccgcgattcgcggaagcgtaaagctcttgacagcgacgccgtttgagaagctgaatgaagcaaaattcagaaaatatatggggctgattgctgatgaaacggaacgcatgtccagcttgtcgtcgaatttgctgcgactatcccgcctggaaaatcaaagcgcggcagaaaatgtcataaatttttcgctggatgaacaattgcggcgctgcattttacttttggaaggacagtggagcacaaaacccgtcgaattggatatccagcttgatcggatcgattatcgaggagatattgaattgcttcagcagctctggctgaatctgctctccaatgcgatcaaatttacagaccctggcggaaacgtggggatcaagctgcgtggcacaccggagggcggcgcccgtgtggagatctctgatgacggcgtcggtatgtcgccggagactcaaaaacgcgtttttgaaaaattttatcagggtgacaactctcgtgcgcgtgaaggaaacggacttggtctttctattgtacggcgcattgtcgagcttcattcaggggtgattgtatataaaagtgagttggggaaaggtacagtgtgcactgtgaccttgcctgggaatcgttgataagccttcgggtgaattgcaagtgaaattgcgaaaaaagtagtggaaatttaaaagtttgttcattcttaacaaaagcagtctccataaaataggaaaaaggttgaagggcatagcttgcccctcaaccttttttgatgatgttctgagactatagaaacgtaatggtattattccgtcaaagatgcatcataatcacccgatcgtgtgggcgcgtcagattcaaccccggacacaatatccggacaattttccgggtcgaatgggtcaggaaattcgatatgagaagccacgtcaacccattccgtagaagcatcgtattcatacggtgtcccatcctcattcacaaatacagggctgtccggtatttcagccgttttaagccaatgactgaccaacggccacacaacaacagcgcataccagcaggaagatcaaagcaagaacaaaatcaacgagcagttgaatcaccggcatattccataacgccttacgaaagaataaccggatgatcataaaaatagtccccgtaattaaaaatgggagaatcatccctaaaaagactgaccatatcatttcgccgatatgttctccattcaatattggcataccgtcacacatcctcaaacagtcatagggttttcaggtgggcaagaaaaagatcgtcagagcatttgtaatcaagaatcttgcgggggtagcggttcatccaatcctgaatgcgttggatgtcctgttcgctgtagttaactacagcgaacaggacatccaacgcattcaggattggatgaaccgttatccccgcaagattcttgattacaaatgctctgacgatctttttcttgcccacctgaaaaccctatgactgtttgaggatgtgtgacggtatgtatttttatctttttagcttatatctgtgtttcatactgtcaatttttcctgtgggttgctttatcgttttgtatgttcggatttccggttatttgaaggcaacagatttttcttttctttcggtacttcttaatacgggacgatatggtgaggctttgttgttttcaatgcttgattcccgaaaaggtcaaaaatatatccttcccaatgtgtatttaaatacttgttcgggtaccttaaccgaaatagatttgatcttaattacccacaagggcttatttgtctttgaaagcaagaattacagtgggaaaatttatggcagtgatcataaactttattgggatgtatattataggcgaaaaaagtatcaaatttacaatccggttttgcagaatcgcacacatgttaacgctttgctgtataagtttccaatgttaagggctgaggatgtttactcttttgtagtatttgggaatcggagtgtattaaaagtaacatccaatgaaatcgttatacatcgaaaaatgctttcttctgttttggatagattagggaagtctttaccagatatttttgatttagatgaaatgtcctttctgcatgcaagtttaaagctatgttctaatcccgaagattttgtaaagaacaggcaccttgaatatgtttccagtttaaaaaagaagcattctcaataaagagattgcttcttttttggttaagtgtacaaatctttacgaatgcattaaaattttcgcaatttcacttgcaattcaccatataggctgcgccggcccgtctgacagccgtgccggaatattccaagggtgcatgctactaaaaaccgtccgttttatgccggcagccggcaatcaccgcatacggagccgctgcaaagaggattccgccagccatgttccccgctgttacgaccatcaaattatacagccatccgcccgcgctcacagccgcgccggccggattcagcagcgcaatggtcaatagcgtcatgttggcgacactgtgttcaaagccacaggtgataaacgcgaacaggcaccaccagatcatgatgagctttccgctttcgcttttgcagcgaaagccgcaccagaccgccagacagacaagcacgttgcaaagcacgccgcgtaaaaagagatgcacaggcggcagcgccatcttccccgcggcgccggacgccatatacgctcccacagcgccgtccgtcagtcccgcgccataaaacatcgctgccagaagaaccgctccggccaggttaccgagccagcaaacgagccacagcctgactgcaccgccccacccgacagtcccggaaacagctccggctgtcattacaaaattgtttccggtgaacaattcgccgcccgccatcaccaccaaactgagcgccacgccaaaagacacgcccatcagcacctttgtatacgccgcaccctccagcagtccgccgattgtaaacgccagcaggacgccaaagccgataaacgcaccggccagcatcgacgccagaaaatacccagccggattccgctttaaaaacgcagcctttgcccttgcggccgcggcggccgccgcaaattcctcctcaaacaaacaacttcccccttcgatgttttttcctgctcagtccgaataaaacgcttcctctacatgttcttttggcaaggcgagcagacggaaatggctgcggctatattccaaaacgccctgcgcgcgcagctttgataaaatcgccgacatggcgctgcgctccacacacagatagtcggccagctcctggcggtcaaacgagatgtcaaattccgtactgccgcaaagcgccgcctgttccgacaggtaggacagaagcttttcgcgcgtcgtgcgccgggaaagatggccgatcctgcggttgagcatcagatttttgccggccatcaccgccagcatattttcaacaagctggtcatgaaacgcacagctttccgggccggacgagatgatccgccggtaatcgagcagcagcacagcgctgtccgtcacggaaaacaccgagacgggcagcgttctgtttccgccggacgcgcatacaaacgcctctgcaaacagatcggccggctcaagtcctgtcaggatggtgcggcttccggaaagctcctcgcgcacgacctgcgcccggccctcaagcagaatgccgacacggtcggcgggagcgcccgccagcaggatccattcaccggccagaaaatgccgcggggaagcattaagacaagccagcatccgcgggtaatcggccggatcgatcccatgaaacagcgagatgctttttaaaatatcaaaaaatttttccataccgcctccgttgttggaaaaacaacatacaaatccgctctcgtttagtatagtacgaacagaacaaaaaaacaagctgcatccagctttgattttggaggcgtttacatgaaacgtaaaattatccgtatcgacgaagaaaaatgcaacggctgcgggctgtgcgccgaagcctgccacgaaggcgccatcggcatggtggacgggaaggcaaaactgctgcgcgaggattattgcgacgggcttggcgattgcctgccggcatgtcctgcaaacgcaatctcctttgaggagcgcgaggcccccgcttacgaccatgcggcggtcatggctgccaaagcccaaaagcagcaggccggcgggccgctcccgtgcggctgccccggcagccaatcgaagcgcatcgtgcgcgccgaacatgcgcccgcgccgtccgcgcagccttctgatgcgcagagcgagctgacgcaatggccggtacaaattaagctggtacccgtcaacgcgccttattttgacggcgcgcgcctgctcgtcgccgccgactgcacagcctatgcctacggcgcgttccaccaggagtttatccgcgggcgcgttgcgctgatcggctgtcccaaactcgatgaaggcgattatagcgaaaagctcaccggcatcctgcgtgaaaacgacatcaaaagcgtcacggtcgtgcgtatggaggtcccctgctgcggcgggattgaaaatgccgtcaagcgcgcgttgtctcaatgcggcaagatgatcccctggcaggtcagggtgatctccaccgacggacgcattcttccggaataagcataaaaggcgcccccgcagagcgggggcgcctttccgttttagacgcgcagttctcgcgcgcgtctgatttcatccatgaagcgtttcgcacgcgccgggtcaatcggatttttcatatcgccgtttttgacccaggtcgccacgctgacgccgtcaaaatgctgcatcagctcgcagatattgtcgccggtcgcaccgccgccgagaaaaatcggggtttccggcacacgcgtgcgcgcacggcggattagctcgatgctttccgcagccgttcggccgcttataaaaaggccgtcggcaaacgcctcatgcaccgattcccatgcggcgtcctcgatgggtttggcgccgagcgggacgccgtgcacctcgtaaacgtcggcatacaccggaattttgctgcccaggcgtttgcgcagctgcgctatttcgcagcattgtccttccagcaggcccgcgcttgtcacctccacaccggtaaacaggtgctcgacacgtacaaaatccgcgccggccgcctcggccaccgacagggcggccacgccgtcccagttgacgagaacgcccatgacaagctccgggaaagcggcgcgcaggcgcgccgcgatggcggtcattccggccaccgcttccggcggagctgtctgcttgacaggcatgtcgttcatattttgcagaatgaatccgtcaaagccgttttcagccaccatcccagcctcacgcagcgcgagatcaatgatttcatcgatcttcatacccatgttgcggtaactgcccggcaaaggctccggctgaatcatacacaaagccagcgggccagtttttcctttcatcatcagtcgtttcctccggctaaaaattcagcgtacttcacagatcgctcgaacattgactgcgcgggaattacgccctgttccgtgataaacgcacggatcatatccgcaccaaccggcagaagttccgggcagtcgaaatcaacctgctccaattcctgttctgtaaagccggccgttttcattttttcacgcgtattgttgtttaccagcctgcgcacaaagccccgcagcgggcgcatatccagcttcatcagcggcgtcagcacatatagcggcaccccgcattcccggcaagccaaaccgacgatatcggaacctgtcgtattgaaggccgtgccgtccggataaaaggtttccgctccgaagtaagcggcgtcgcatgttttcagctcgtacaggatagcggcgtccgggataaaatgcacacgcagccctgcggcgagcgcgcccggcacaaaagcatagccgccgttgatcacccggctttcggggatcacaaccacagcgccggggcaggctgcgccgaatttttcgagaaaacggacaaccgtactggaatagtcgaataccagaatgcgccgcatgccggcggcaagggaaacggcatagtctgtcagcgtttcgatgctttgacgcgcctgtttgtcataggatgaaaccgcgcgcgtcaccgctttggccgcttcggaggcgggcaggctgtcaagcgtgccaaaatcccgtgtcatcaggtcaatcgcatttccaatcgcgctgctggcctggccgcgcgtcgccttaaaatagtcggccagcgcggttaaatcacgcagcatcgcttttgtatcgccgtttttgacggcgtaatccgacgcaatcgcacacagcatcgcgccgatcatggcgatatgccggctcgcgccaagcacacgctgtaaaacaatatcgtcaaaattggaccgctcaggttccggcagaatcgaccggatctccgcttccgtcaaatgaagcccccctctttgttgatcgcttcggttcgcaaatttccccgcatactccttataccgggtcttgggagcaggcagaagcctgaacgcggttatatctgttccggctctgccgccaaaaaagcaagcacctgctcccgtgccggcagccctgtgcgcgcgccgaccgccccgatggagattgtggacgcagcggccgcataacgcgccgctgccttaggatcgctgccgcgcacgatttcagagagaaacgccgcattgaagcaatcgcccgcgccggtcgtatccgccacatgcgccgcccggtaggctctatattgaatgctttgatcttttgtaaagacggcgccgcccttctccgcacaggtgacaaccatatactgcacgccaagaggcagaatgcgttcggcggcttgatccatcgtcaggcccggtaaaaggctttccagtccgtcctcgttgacaaacaggacggaggtctgttctaaaactggtttccaggcgtcaaaacccggatgttcggcatgcgcctcgtaatcaagcgacaggcccgccccgctgcctgcaatcgtctttgcgacatgcaaggcgagcgtatagtccatggaattgacgtgtacatatttcgcctgacggatataatcggccggcacctgttccggccgtgggctcatcagcggcgtctgcacagcggtcaggcatttttcaccggtcccgtcgatatgcaccacacagtaaaacgtcgccttcccaggctcgacggtcagccccgccgtatcgattccgcggccctgatagtccgccaaggctatttttccattctcatcgtcgcccaccacagaaacaatcccacagctgacgccgtgctttgcgacgcccgcgcagaaattgccgatcataccgccgggcagtttcccgatttcgcgcgcgcgaaccttttcgccgcggcgcggcggatgatccacctgtaaatagacgtcaacatcggattcccccacgccgataatctctggcatatagcccctcctttccataagcccgtctggggcgtgcgatctggcgccgcgcgccccggacctccgttttgctgtttatcccttcggatacaaaaccttgtgaatcgcctcgtcgttcatgttgtccttggttgcgatcacaacctccggcgcgacggtcttgggaacctcctcgccattaagcgccttgacagcgtattcgatcccgattttccccatctcatacggctgctggacgacaagcgcgtcgatggttccatcctcaagcagtttgatttcatcggcatctgcgtcaaatgcgaccatcttgatctctccggccttgcccttgctgacaatcgcctgtgccgctccgagcgcgcctcggttaaaggtcgcaaagatccccttgagatttgggttgccgatgatgacgttttccgtcgctgtcatcgcctccgcctggtcgagacagtgctgctgcggcagcaccgtgacgccgtcgactgtcgcggcgtattcctcagcgccctgtccgcgcgcgtcattggaggggatgcccgccagcgcgttcacaacgaccacttctccagaaccgccgatggattcaatcaaacgctccatcgccatcctgccgcccgcaacgttatccgtcgcaataaacgaagtgtatttatccgtattgacggctgaatcgatcacaatcaccgggataccggcgtccatcgccttttcaaccggcgcggccagcgcgtcgctgtccagcggagtcagcaggatcgcgtccactttgctgttgatcagattttccatcagcgaaacctgtccctggatatcgttgttgtcggcagggccggtaaaaaccagctctccgccgattgcatcgaccgcctcctgggcgccgtccttgagcgtcagccaatagtcgctgttcgtcgacatgacgaccagaccgaatgtgagcttgtcatccggcgcatcggccgcgctttctgccggcacggacggcgccggcgtatcagcgggggccgatgagtggctctgcgatgaaccgcaggctacaagggaggccgccatggcgactgacaaaattgcactgagtatccgtttcatttgatctcctcctgattttattttctgattataaatgctctgatttggaaattttctcttttctcgggacaaggtgcaggcgtttgaacggcgagccgctgctgcgctgcaaaatatcgaggtaaacggccatgatcaggataaatccgatcgcgctctgctggaaaaatgtattgacatgcagaagcgtgaaaccgtttgtcaggatgctcatgataaacgcgccgacgatagcgccccataccgtgccgacgccgccgagcatactcgcgccgccgatgaccgacgcggcgattgcgttcgattcatagccggtggccgctgtcggctgcgccgccgacaggcggcccatcagcagaataccggcaacggcggccagcataccggaaagcagatagatacagcgcgtgcgcgagccgacattgatgccggccaggcgcgtcgcctcggtgttgctgccgagcgcgtagatctgacggccgaagatcgtctttgaaagcacgatctgaaagataatcgccaggactgccagaatcagaatcggcacggaaataaacagcaccgtgccgttgccaaaccagttgatcgactccggcagcgaggataccggtagtccatccgtaatgatgagcgccgcgccgcgcagtacgcccgtcataccgagcgtggcgataaacggcggcagcttcatctttgtaacgataaagccgttcagatagccgaccgcagcgccgattgccagcgccgccaggatgcaaaccaccagcggcacgcccgctttcagcatcagcgcggaaataaccatggaaaacgcgagaacagcgccgaccgtcaaatcaataccgcccgtgatgataaccagcagctcaccgattgtcagaacgccgataaccgcggtctgtttggcaaccgtctccagattatcagccgtcagaaagtacgggcttgcaatcgccatgattacaatcaaccccgccagaataaacagaggtccgtattttttgagcatattgaaacaatccctcccacaaagtgcgccgccttatcggctacacctgaacatcctttgtcgcgagtcgcatcacggcgacctgatcggcctgccgcgcatccagttcgccggtgatcgcgccgcccgacatgaccataatccgatcgctcatgccaagcacctccggcaggtctgacgacaccatgatgaccgcttttcccatctgggtaagctggttgatcagcatgtaaatctcgcgtttggcgccgacgtcgatcccgcgcgtcggttcgtccataatgatcacgtccgcctcagtacacagccagcgggcaagcaatgctttctgctggtttccgccgctcagagaagcgatatcggtgttgaccgtcggcgttttgatcttaagctccttcacatatgacccggccgtttcctcctccagacggtggcgcaaaaaaccgcccggcgcatagttttgaagcgaagaaagcgtaatattttgatccaccgccatgcccgcgatgatgcccgtatgcttgcggtcctccgtcacaaaagccagcccgtgacgcacggccgcctttggagatgagattctcgttttcgttccctttatataaagatcgcccgtcacgcccggatcggcgccgaagatggcgcgcatcagctcggtgcgccccgcgcccatcagcccggaaaatccgagcacctccccgcgccgcaccgaaaatgaacagtcgcgcagcacgcccggacggctgatatgttcggcgcgcagaagctcctcgccgggctcgctgtactgtttcggaaacagatcgccgatctcccgcccgaccatcattttgatcaggtcgtcgcgcgcggttgttttcgcgggcacagtatccacataggcgccgtcccgcatcacaaagacgcgatccccgatttccgcgacctcctgcaagcgatgggaaatatataggatcgatacgcccgcggccgtcagcttgcggatctggcggaacagctcctccgtctcctgattggtaatcgcggtcgtcggttcgtccatgataacaacgtccgctttagccatcagtgcgcgtgaaatctccaccatctgactctgcgccatgctcaggtccttgaccggcgtgcgtggatcgatgtgcagattcatctccgccaaaatctcccgcgttttgctgtaaagcatcttataatccataagtccgccctttttacgcggctcgcgccccagaaagatattttccgcgaccgagatatcgggcacaaggtttaactcctgatagatcatgtagatcccgcatgcctcggcgtcctttgtgctgcggatatccactttctttcccttataataaatctctccggaatccgcgttgtacacgcctgcaagcaccttcatcaacgtcgatttgccggcgccgttctcaccgagcagaatcattacttcgcccggcaaaagcttcagcgacacgttgtcaagcgccttgacgcccggaaacgacttgcagatgccgcgcatttcaattttatattccatccgaacacccctctgcttttagggactgtccctatccgatttccaacgtctcgccgcccgcgaagtctatccagggctgtgcatcctggtcgaccaaatccgctttttgttccaccaggaagaaatattccgcttccccctgcaccgcaaaagccggcgaatgccaagcgccgcgcgcgatgatgaccgcctgccccgccttgatccggaatacgcgcgtcgtttctatattcgggcgggccagcgcgtcgcccagacgtaccggcagatccacagccatcacaacgtcgcgcgtcgtggtccagagcagctcctcgcggctgacatggcgttccagtgctgtgatctgaggggcctgcccgcacctgacaattccaacgcccaccggcgcatcgggcagcataaagtcgacaggcgaccagcagacccatcccgcgccctgctttgtgcaggcatgatccgggacctccagcacacggccatatggggcgaaactttccgttgtcagttcttcaggtttaatttgtaccatactccattccctcctgccgcggcgtcactgcacaaattcttcggctgtgcgccggcctacataatggtgctgcacattaaacaggttgatatcgccgatctccgtcagtttgcgcatggtttcctcaagaagttcgatgttcgggcagagccagaatgtaaaataccgccattcgcacgaccaactgcaatcaaaattgccgaaggtctgcacgcccttggcgcgcgcctcgtccatcaccgaacggagcttttccatgaacatctgttttgtttgatcatccgcacaaaaccagcggtcagttgccttccagaaagcaacaaatccaagcggctgctgattcattttctttttcctccttaaaattgtttaataatgttttattttgttttattaatcgatcactttagatcaaataataataacttcctatcgatttgtcaacccgatttcgcaaactttagcatgattatagattttccggcataaatattattcaatttgctcaattccttcttgcaagcatttacaaaagtgtcttgatttgttatccttatcttcaaaagcggatgtttgaaaaaccaatcacaccgcacaatctatcgcggatggagatgttcgaatgctaaaagacgaacgcttaaaggaaatcgaaaccatgctgcaaacgaatggaaaggtggaggtcggcaacctctgccgcatcttcaatgtgacggaaatgaccatacgccgcgatctcaacgatctggttgcgcgcaaccttgccgtgcgcagccacggcggcgccgtggccgcgcctgacactatgctgaccgaacggccctacgagatacgcatcacgcgcaatctgcgggaaaaggaagccatcgcgcgcgaggccctgcaatttatcggcgacggcgaccgggtattcttcgactcaagcaccacggtctattgcctggcgcgtctgatctcaaatacacaaaagttccttgccgtaaccgataccctctccacagccatggagctgaacgcgcgcaccagcctgcgcgtcgtctgccttggcggagagctgaaaaaaacgacaggctcctgtaccggcacattcgctgaacagatgctcaaatccatgtacttcaacacagtttttatcggtctgccgcgtatttccaaaacaggcgtcctttccacctccagcatgagcgagctttcaatcaagcgcgccgcgattgatcacgccagccaggtcatcgttctggccgacagcagcaagatcggagaacctgattttcttgcaattggcaatctctccgaggttgatgtgctgatcaccgattcaaagattcctgcggattttgtgcggtattgcgaatcaatcggcgttcggacaatcatcgcacaggcgccgccggtctgaagataaaaagggaacgggacttcgcatgaagtcccgttcccttttcgatgtcagaatctgtattcacggctggagcatgccgggcaggcgttttgcggctgtgaatacaggttgttaatatctattaacgaatatatgcgccgttcgcatcacacgccgctgtctacagacgcttgacgcaggaaaaaatcagccgcgccgcgtcctcataaccgtcgagcggcagcgccggcacccctgggatacgcacgcccgtatcggtggcgagcgcgagcagcgtatcggggcggcaaacgctttcatttgagacggcggcgcgcaccagctcgatcttgggccaatcagaatgcttttgcccctccagcagcacgacgtccatcccgcgcatttggtccaacagatcgcttaacgcgacatccggctcctcgcagacaagcatccagcgatttgcgctgtaaacggccacggcctgcgcgcccgcctcccgcagacggcggctgtccgtcccggggacgtccggctcgaaatcatggccgtcgtgcttgatgatcccaacacgcagccccatcgcgcgcagaatcggcgtcacatgctccagaaacgtcgtcttgccggaattttttacgccgctgacggcgataaccgccggtccgctcacaataaaagcacctcgaccttgtcgcctggggcaagcggcgggctgcccgccgggatatcgatcaggcagttgcagccggcaagcgatcctatcccgccggatgaatggcctgcggccggcggcacgacggtttccccattgtaccgggcgcgcacaaagcgccgcaggtcggaaggtttcggaaacccggtttccagacgcgcgcagcggcgcacaaacgcctcgcccgcttttccggacagcctgtgcaggaccgggcgcgccagcatctcaaacgtcgccagcgccgcaaacgggttgccggacaggcacaaaaccggcttgcccgctatttcggcgccgagcgcgggggaacccggcttggctgcgatgccgtaaaacaatatattcccgccggcgcgttggacggcttcgggcatcaggtcgcgctcgccgaccgagacgccgccggttgtaatcagaaaatcacaggatggcagcgcctgcgatatacgcgcacagagcgcgtccagatcgtcggcgcagggggaaagcggaaaagcctgcgcgccaagctccgccagacgggcgcacagcatcgcacagtttgaatcgtaaatctttccgggcgcgagcggcaaaccggctcccgtcagctcgtcgccagtcgacaacaccgcgacgcgcggcttttttgacacctccacagacgctatcccctgtccggccagcagtccaatccgcgcgaaatcaagccgctgcccgcgacgcgtaagcggctctcccgcttggaaatcctctccgcgcaggcagatattcgcgccgccggaaacggatttataaatggaaaccgttttttggccgcagtccgtctgttcctgcgccaccacacaatccgcgccctccggcacgggagcgccggtcataacgcgcgctgcggttcccggcgccaggggagcgggcgtgctgcccgcatacaggtgcagcgaaaccggcaggaccgccggttttgcagagctggcctgcgcaatatccgcgctgcgcgccgcgtatccgtccagcggcgaccgtgaaaacggcggctggcaaaccgccgcaaaaatatcctgcatacatacgcgccccacagccgcctccaacgggatgcgttcggccgcgcaggtatgctttacacatgcgcacagcagacgcgccgcctcctccacaggcgtccgtccacgttttatcatgctgatgacgctcctttcaaagccccggcctttcgctgccggggtatcctgttctatgtcccagtataccggcccgccccatgtaagtcaatcgggggcatcgcaaaagcccccgccgcgtcaaatcccgaacagggacaggaccccaaccgcaaccggcgggaccagcagggcaggcagcagattgagcgttttaatccgtttgatatccagtatcccaagccccgaactgagaatcagcacgccgccgacaagcgacagttccgtcagcagatcgggtgtaagatacggcgcgatcacgttggccagcagatagatgccgccctgccataaaaagaggacggcggcggccagagcgatcccaaatccaaacgtggaggaaagcacaaccgacgaaatcccgtcgaggatcgcatttgtaaacaggtaggtattgtcgccgtgcagcgcgctttccatcggcccaaggatagaaagcgtacctgcacagtacagcaaaatagccgtcgacaacccctgcgccagattggaaccgccggaaattttagaaacggcccgcgcaaaggccgtatcgagcgaaagcttcgtcccgatcagcccgccaagcgcaaggctgacgataaaaagcacgcggtatctgctggcgggcatcgcctgcacgatggcattgatcccaagtgccgtggccgccagtcccatggcgtccatcataacggttttataccgttcgccaatcccttttttgagcgtgccgcccacagcgcatccaatcaatatagcgcccgcatttgttatggtgccgatcatgttcgggtcctccttcggctttactgtttaaataccccttgtgtttttgccggaatcattttatgatagaataaacagcggcccggcgccgcgcttgaaaggatgcgtttttatatgtatcaaccggcttgctgccgccggcccgaatcgggcgcggttggtctgccaaccccgtccgcccgcgcgggcggacgctgacgcgccgtgggcgcgcccgcgctcggcgcgctggtgctcgccgggggcgcggcccgcaggatgcaggggcaaaacaaggccctgctgcgtctggaggggcgcacctttctcgagcgcctcgccgaagcgtttgacggctttgacgaacgcctgatttcaacaaacgacgcgtcatttgcggccggttcgccctttgtgcccgttgccgaccggacgcccggacgcgggccgcttgaagggcttgcgtctgcattgacggtctgcaaaagcgacgggcttgttgtggcggcctgcgacatgcctcttttttccgcagatctggcgcgttttctcgcgcaggcggcgcagggccatccagccgccgcctgcgaggaccgcgcgggacggctgcacccgctctgcggcgtttacatgaaaacgtgcctgcccgcgctcgacgccgcgctcggtcagggacggctgcgcatgatggacgcgttttacgcaatcggcggcgctgccgtcccgctgggcggcaccgcgtttgcggacagcgtgctgacgaatatcaacacccccgacgcgcttgagaagctgattgacacgccttaaaaacagaaccggcttgtacgtcacaggcgggcgggccggcaaacgccggcccgcccgccttcgttttttcacccttcgcgccagcgcgtcacagcgtcagcgtcggagccgcgtatgtgcgcgccgccagctcgctgtccagcatatacagcgccttggggtcggagccgtaaagctccatcttgcggaccaggtcgccggcgtttttctcctcctcgccctgctccttgacaaaccaatcgaggaactgcaccgtgcggtaatccttgactgtatgcgccgcgtcataaatgttgttgatcagcccggttacatagcgttcatgctccaggctggcgctcaggactgaggcgtaatccgcgaacttaccaattggctgttcgaccgcctccagcgtcaccacagcgtcattgttctgcatatacttcatgaacagcagcgcgtgatcgcgctcctcctgcgcctgtacgctgtaccagttggcaaagccgtcaagcccctgctgtgtgaagtagttggaaaaggacaggtagagatacgctgaataaaactccttattgatctgtgtgtttaaaagctttgctactttttcgtccagcattgcatgatgcccctttcgttttttgtcttatttaaatttcaccgctgtcccgtaggccatcacctcggccgcgccctgcatcaccgaggcggacgaataccgcacagcgacaacggcgtccgcgccgagcgcctgcgcttcgtcgaccatgcgctgtgtagcgatgctgcgcgcctcgttcatcatatcggtgtatgatttcagctcgccgccgacgagcgttttaaagccctgggtgatatccctgccaatgtttttggactggatggtactgcccttgacaaggccgagcatctccagctcgcggccggacacagtttctgtggtaacaagcagcatagaatcgtctcctttttgccaaaattgcagacagtatcgtgtccacgcctttattatagtccgccgaggccctgattacaagccgcaaaatacgcgccgcccccaccaatgaaaaagccatgccgtgcggcatggctttttcattggtatgacgcgggattatctgtcaatccaagcaaataatcgatactcgtatgatgaaacgaagcgagcttgatcaacgtctgtgtcggaatattgattttgccaagctcatagtcagaatatgtagtctgcgagacatgcaggatctccgccatatccttctgcgataaatccttatcctctctcatatttctgattcgttcgttcatgccgatcacctcatatcctatttaaccacagccaaatgtaaaatttcagttttaacggtatttacggtaaaacctgaatcggagcgtaacagccgttaaaatggaaccgaggtgatcgtatggaattatacaaggaaatcctggtcaatgtcctgcaaaggcagcaggtgcgcgtgctgttcccgcgcctgaaaatcagcgcccgggagattgtcggaatggaatgctacaaggccctgcgaaaaatccgtgcaattctcgcggacgaccgcctgaacgacgcggagtgcttccaaaaaatcgaggaaatcgtccaggtgtttgatcagatgcacgtcggctgcggcggccggcacgatttcggctgacgggaaggattgacaagcgcggctggcggggctatactaaaattattcccgccgccatgaagacggcgttcaatcgacacaatgaaagagccaggaaggccgggccgcagaagcagcctgtcattcccgcgctctttttttgtctgcgcggacatcttttgatttttgggaggaatcatcttgaacaaaaccgctacgcaaaagctcatgaccgccgcgctctgccttgcgctggggctgctgctgccctctatgttccacatgatcggcgcgggcaccgtttttctgccgatgcacatccccgtactgctgtgcgggatgctctgcggcggggcgtatggcgccgctgtcggcgcgatcgtcccgctgctttcatctctgctgacgggcatgccgccgattttccccgtcgcgccggcgatgatgttcgagctgtgcgcctatgggctgctctccgggcttttctaccacagcctgcgccgcaacgtctacctgtccctgatcggcgcgatgctcggcggacgcgtcgtctccggtatcgccaatgcggtgtttatgggcatggctgataagccctatggcttctccgcgttcctctccggcgcgtttgtgacggcgctgcccggcatcctgcttcaattgatcgtcatcccccttcttgtgcttgccctgcaaaaagccggcctggcgggccgtaccgccgccgcgcgttaagaaaggagccgccctctatgtttgaaatcgaacaggtacgcggttattttgacgaacgcgcgtcccaatgggacgccgtttgttcccacgaccggtacaagcttgccgccgtcgttacactggcgcgcgtcacgcccggcgcgcgcgtgctcgatattgcctgcggcacgggcgtgctctttgatgagctgctttcacgcaatcccgcgtctgtgctcggcgtggacctgtcgccgaatatgatcgcgcaggcacagcaaaagcaccgtgacccgcgcctgcaaacgctggccgccgacctgttcgacgtggaggaaacgggtttcgatacggcgatcatttacagcgcctatccgcattttcccgataaacagcgccttgcgcagaaggtacgcgcaatgctcgcgccaggcggccgttttctgattgcgcacagcgaaggccgccaaaccatcaacggccggcacggcggcagcgcctccctcatttcgatgccgctgcgtcccgcccgcgaggaggcggccgcgtgggaacccttctttcaaatcgatatggtcgccgatacgccggacctgtacttcatttccggcacggctgacaagtaaaaaggggccgccggtaaaggggcacacccataaggaagtaattgttaagttgcagggcagcatagcggtttgctatgctgtcttgctttttctctgccgttcaatggtctgcttattctcgtcctgttccagttctccgataaagttccatacaatctgtatcttctgtctgcggtgtccgcttgatttatccggcgcatggacgatgattttctttacaaactcattgacaatagtgggcgttagttcccgtattcctacatacttgcggattatagcggcgaagctgtcaaaatcagacttgtcctgttcgtaggtatcaacagcggcttgctctttctggacaaactccgtcaattccttttgctccgcttcatactctgcggacagcttcaaaaatcgctcatggctgattgtgccgtttatagcgtcctcataaatccgcttaaaaatacggtcaagttcggtaatccgtttccttgcctgttccagttcttttttctgccgctttactgccttttccgcttctgtaaatctctgctgatatacgattttctgaaaaccctgtatatcatcaatgaacatagccgttacatcaaaaatcctctgccggacaaacagcttcaaggtttcttctctgatgaaatgtgcagagcaagtacctgtattgctcttgtagttagagcagacataatgctcttgtttcggcgtgaagctgtttgttgtacagaagtacagcttttcgccacagtcagcgcaatagagcaagccagagaacaatccttgccgccctgtctttgcagggcggcgtttgtttgcccgtagttccagcacccgttcaaagacttttcccttgataatggcaggctgggtattggggaaaatccgttgattttcgggagcgttttgcagacgctttttcaatttgtgagatttggaataggttttgaagttgacggtacagcctgtatattccgggcgttccaaaatccccgatatggatttgtaatcccaccgatacagattgtccggcatagtctttccgtcacgctttgcatagtaggctttgaccgtcaaaaccctgtctgctgtcagcacttttgctatctgcattggtccttttcctgcaatgcacaaatcgaaaatcctctttaccacctcggcggcttcttcgtccacaatccatttctttttatctgccgggtctttcctgtacccatagggcgggttggtacagaggtgttctcctgcattgccctttgaccgcataacggctctgattttcttactcgtatctcgtgcgtaaaaatcattgaacaaatttcggaaaggagtgaaatcattgtccccctttgtactgtccacgccgtcattgattgcgatatagcgaatatcacgctcggcaaagaaactttcggtgtaatatcctactttcagataatcacgccccatgcgggacatatccttgacaataacagtctggactttccctgcttctgcaaggcgtatcatctcattccaaccgggtctgtcgaaagttacaccggaaacgccgtcgtcaatgaaaaatgtaggattagggaaaccgttgtccgttgcgtatttaagcaggattttcctctgattggcaatgctgttgctctctccgtctaaagcgtcctcttgacttaatcgggcatataaagcggtaatgttgtcgggataatttttcgttgtcatgtgttcattcctcctgtaatgaacgcccgacaaacaggttgctatcttcattatagcggactttctctttcttgtcagtaggcgtttttatagtttctgatttaataagtcgttccattttgtcatagagtagttcggagccgccgcaaaccgtttccacctcaaagattgtgccgccgatttggtagataactgtttcatgcagtggatttcccctttgtggtaatagattatcttgtttttcctctcgtttccgttccattccttttccgtcctttctttgatttgtaatgtgataagtttctcagcaagcataggaaaagagtacccttttccgtattttcgcccgattgccctgcggcatatcagttgaaaattgcttgttgggaagtatcccaaaccctctgaaaatcctctcaaaacttatccgtctggataaaagggatttgttgcattttgcccctcactatatacaacaccggaaagggcgtttttgccgaagttttgagaaaatttcttcaaaaagttttttcactttatacatacggtggattttccaaaatgccaaatgtgagcaaaagaaaaacgccgcagtctgcgacgtttcacaaatcatttcgagataaggtttcttaattattccttgctttatattcctcgccccaatcccacatagcgtcaagaatggggcgtaagctctgccctaattcggttaaggtatattctactcttggtggcacttctgcatatacggtacgagttaataagccgctatcttccatagcccgaagttgtgcagtcagtaccttttgagatacatttccaatagaccgcttcaattctccaaagcgttttgttcccggcagcaagtcacgcagtatcagcactttccatttatccccaatcaaagttaaagtcgtttctacgggacaagcaggcaattccttttttatattttgattgctcataatcatacattcctttcaatagtttcatttagaaatcttgcttctaattatactatatagagattttagcgtcaatgcgcttgttggaaatcaaaaacgaaaaaaaagaaaaatttttttgattacacaaacaacacccaaatcccgaaatcacgcatttgtttccttttggtaactgtctaattgtttccttgcggtaactacgccacaatattgtgcgtactttacgggcaaaacagccactcctataatatagacaagagctacgaagaatagcagctgcaaggctcaaagcaagaccataaggagcaaatcactatgaacatttttaagaaaatctttggcgacagccagaccaatatgaaggaggaaatcaaaatgacaaatacacagaaagctctcgaactcatcaatacctttgcaaatggcgatacggaaaaagcggcaagtctgttggcagaggggtacattcagcataacctcgcctacggcacaggacgcgacgcttttgttggttcggttgcctaccttgcttctgcccctgtcaagactatggtaaacaatatccgcgcctttgaggacggcgacaaggttttcttgcaaacggtttataactttgccggagcgggcgaacaggttgcttttgacatcttccgctttgatgaaaacggaaagattgctgaacattgggataatctcgttgcaaaggcagaccctaatccgtccggcagaacgcagattgacggcactatggaagtgaaagaccttgataagaccgaagccaaccgtaaggtggtaaaagacttcctttacgacgttatgcagggcaaccgtcccgaaaagaccccggattactttgacggcgatacctacattcagcacaacacaggcattgccgacggactttccggattgggggctgcgctggcggcaatggctgaacagaacattcagatgatttatacaaccgttcatcaggtgcttgcacaggggaattttgttctcgctgtcagcgagggaacttttggcggtgcgcctacttcttattatgacttatggcgtattgaggaaggcaagattgccgagcattgggacgttatggaaacgattgcggacaaatccacttggcagaacgaaaacggcaaattttaagagaagctcgaaacctcaacgccccactgccttgaaatatgcggggcgttggggcttatatcatggcatgggagagaaaataaagtggactatttacgttttttagagcaggaaatacatactgtcattgttgcgactgttgacgatatggggctacccgttacctgcgccattgatattatggatagcgacgataaaagcttatattttcttaccgcaaaggggaaaggattttataatcgtctaaaaaagaacagctatcttgcattgactggaatgaaaggcaacgataccttatcctgtattgctgtttctgttcgtggtaaggtatgcgaacttggcaatcagccgattggaagcctgtttgaaaaaaacgggtacatgaatgaaatatatcccacagaacaatcccgtcaagcacttaccgtctttcagctgtacgagggcagcggcgaatggtttgacctctcaaagaagccgattgaaagagccacatttacaatcggcaatatgcaggagaaaatacagggttatgagattacgaagaagtgtatcggctgcaaaacctgtaaaacggtatgcccgcagtcttgtatcgactttaccacaattcctgctgtaattaaacaggaaaactgtctgcattgcggtaactgttttaccgtctgtccacagaaagcggttataaaaagaggataagaaaatgacacaagcagaaagaagaaaatatttaattacagctttgataaaagaacagccgcagtattcaaacttggtaatcccagaggacgagcaagaagaaaaatatctgctccgttccctttttaatattcgtatgccgcaacctgtaaatcaaaagtttttagaagtacaggacgcatatttgcaagaagaaatagagcagcatggaattacacgtattgaagatttacaaccaatacaacaagggatttatctatggcagggagatattactacactccaatgcgacgctattgtaaatgccgccaacagacaaatgctcggttgtttctgtcctaatcatggttgtattgacaatgccattcatacctttgcaggtgttcagcttcgattggcttgtgcagagctaatgaaagagcaaaagcatgaagaaaccacaggcagcgcaaaaatcactccggctttcaatctgccttgccagtatgtcattcatacagtcggaccgattgttggagattgcttgacaaagcaagatgaaatgttactttcttcctgttatcgttcctgtctggaactggcagagaaaaaccacataaggcacatagcattttgttgtatctctacgggagaatttcgctttccaaacggcagggcggcagaaatcgcaattcagacagtcaaagaatacaaagcacagacacatagcagaatggaggtaattttcaatgtttttaaggaagccgattataacatctaccgaaagttactccaaacaaattaacagactgaaaaacgagatagaaaatgccgacgctattgtgattggagcaggggcgggaatgtctgcttcggcgggattttcttatgacggagaacggtttgaaaaacactttgccgactttcatcaagagtacggtattaccgatatgtattccggcggcttttatccctatcattctcttgaagaatattgggcttggtggtcaaggcatatttggataaaccgatatgacgtatgggtgggaaaaccttatactgcattattgcagctcgtgaaagacaaagattattttatcttgacaaccaatgtagaccaccaatttcagcttgcgggatttgataaaaagcggctgttttatatgcagggcgattatgggctttggcagtgttctaaaccctgtcacgataaaacctatgataacgaggaaacggtgcggctaatggtggcagaacaaaaagaattgaaaattccaacagaactgataccccaatgtcccgtatgcggtgcgcctatggcaatgaatttacggtgtgatagtacctttgtgcaggataaaggttggtatgaagcagcgagtcgttatgataagtttatcagacggcataaaggtaagcgtattttatttttagaacttggagttggggcaaacacgcccgccattatcaaatatccattttggcaaatgacggctcagaacgcacaggctacttatgcttgtattaactataccgaggcggtttgtccgtcgcaaatactaaaacagtcaatttgtataggcgctgatattggacgtgtaatttcagaaattgtcgcttaggggggagagaaaaattgagtaaggaaaattgggtgctttgtccgatatgcggcagtaagacgaggacaaaaataagagaagatacgattcttgctcattttcctctttactgtccaaagtgcaaacaagaaactttgattgaagcaaagcaattaaaaatatccgttgtcaaagagccggacgcatagacgcagagccgataacacataaggttttttccttgtggttatcggcttaatttttttgaaataaccgccgttttcctttttcaaaacatgaatacggagggcgtattaaatttgcctatttttaaggatatggcggtatcaaatgcttaacgcattgggaggtatcgttatgtcctttttctacgtccttaatcattatctatcatcaaaaaaagtctgtttcctgtaaggggattttgcggctatgaagatgaacagacaaatcatattgattgcttaaataattcatattacctaaatgcctatgccgctttatgctgcgtaggcgtttgttgtaatagccccctactgggaagaaagggggtgatttcagatgatttattcagagcaatacaaggagcatatcgaatacacctttgcagccttttgcaaaatcgttctccgcaatgccgccctgtctgcttatcgggatattggcaggcggcgaaagtgggaaatttcccttgattatctcatggaagaaaagcactatgagccgtctacaacagacaattactttgataaacaggcaacaaaatttgttgtatgcggcgagataatcgaaattgagaatgaacgattagcaaaggcattttccagtctgccagaactgcggcaggagattttggtgttgtattactttttccactataccgacaagaagattggcgaaacatacggaagaagccgtacaactgcaaactactggaaattatcgtcacttaagagattaagaaaagaattggagagattggagcatgaggaacgaaaagctgataccctttgaaacgattgaaaaagcggttgccggagagccggaagcggtaaatactgtcttattgcattaccgagggtacatcaaacatctgtctgtatttcaagggcattataacgctgaaattcaggagagaatggaagcacagcttgtaagggcaatcctaaaatttcgtttcaacaagtaacgaatagcaaagccagaaacagccgtcaaggataaacgttgcgctgaaagcgtccttgacggctgttactatctttgcttgtgggtagtcaagagagcgcaatcggataaaccgcttacgctctcaaatcattatggagaatgtcacgcagtaggcggtctgaaagccttgattttgtggctttgtgagcgcaaaataaaggagggcaagggttttatactcatacccccgaaaatagcgttctactgcgtaacaaaacaggtagcctgtttacgctccctatggttttctaaacggataatgattgctgtctttccgtttcttttcgcttccattccgacagcttgcgagtagagagaaaattggtggaacggaaaggaatggaatgggtaattgatttaatccgtaattattttatctttactttatatatctttatttaattgcattggattttccgatgtcggattatccggtatcggaaaatccaacatcgggtaatccaacatcggaagcggaaactgcaacatagttttattccatgcgaacagctacatgaattgccgtaggaatgttacgtagtaggggcttaaaaagccttgatttatacggcttacagacacgaaaatatcaaggataagggttttataccttttccctcaaaagtggcgttctactgcgtaacgggatataaaaacagcgtgtaccgtttcttacagtacacgccgctttgttgcaaccctgtttgtcagccgttaagttaattttcttgtgatacttccttatcggagttcatctaacagccggcggccccttttttgaccgcgtcagtcgttaagcagactgagcgtaatttcatatttggaatcaagcgcgttcttttcaggcgcttcccccttatactttgtaacggccgcggatgatttggccaccggctggagcgtaccggcgccggccacacagccgccggggcacgccatgccttccagcaggaacccgtcgtatttgccggccttcgcgagcatgagcagcttgcggcattcgcgcaatccctgcgccgacgcgatcttcacctcgcgttcggggtcgagccgcttgatcgcgtccgacacagcctgggcgacgccgccgctgaccgcgaagccgcgccccgccgcggtcgcttcctggagcggcttttcctccttgatgtcgccgaacttgacgcccttggcgacaaacatacccatcaattcctcaaacgtcagcacaaaatcgacgtcgctgcggatggtgcggcggctggcctccagctttttggccgagcacgggccgacaaagacgatcttgcagcccttgtgctccttcttctgcaaacgcgctgtcaaaaccatcggcgtcagcgccatcgaaatatacggcgcgagcgtcgggaacagcttttttgccatcaccgaccacgacgggcagcaggaggtcgccataaacggctgttcctccgggacggcgcgcataaagtccttggcctcctcgatggtgcacaggtctgcgccgattgccacctcgaccacgctgtcgaagccgagctgcttcatggcggcggtgaacttttcaggcgtcatcgccggaccgaactggccgacaaacgccggggcgacaatcgcaatcacacggtcgccctttttgatcgactggatcacctggaaaatctgccccttgtccgaaattgcgccaaacgggcaattgacaatgcacatgccgcatgaaacgcacttgtcgtaatcgatcacggcgcggccgtgctcgtcgctcgaaatggcgtccataccgcacgcgctggcgcacgggcgctccagcttcaaaatcgccccatacgggcaaacctcggcgcagcggccgcatttgatgcatttttcctgatcgatcacggatttaccgtgtacgatggaaacagcgtcccgcgggcagacctccttgcagggatgcgccagacagccctgacagcagtccgtcacacggtactgcttttccgggcaggcattgcaggcaaatttaatgatattgacaagcggcggatcatagtacttctccgcgactgcgctctggttgattcccatagaaacaggcgcgtgctcgtccatcgggcgcagcggcaggccgatggcaaggcgcaggcgctctccgacaatcgcgcgctccagaaaaatggagtcgcggtactgcgccgtctctccatggacaatcttgtacggcaggccctcgattcgcgaataatcgccgccctcatatgccaggcgcgcaacctctgtaaatacctttcgcctgatatccgtcaccgatgtataaatgcccctcattttgcagctccttccagttttgtcgcgggtcatatctcatatcgtcatacagcaactattatttaacataatgatgctcttgtcaacagtctgcgctatgtttaacaaaaaatacgcacaatggtaattttttcatataatctgttatttcttacagataaacacgataaattaatctcaaaaaagttctgataaaatattccaaaaaatatcttccattttactaaagaatttggtataattaatacaaatagtatgattttagtgtttacttaatcataaggaaataattaaaattagaggttgacaaaaaatgcagattgctgtatacttagacagacagacagacagacagacagacagacagacagacagacagacagacagacagacagacagaataaagtttgtctttttgctgtggataaaataaaaaaagcatctccctgttttcctgacaggggagatgctttttgtcttttttacaaagaagatacgagctgaacaagccaaacgtatcaggatcgcccgacagcctaagcgcggcaaaaagcggacggtgtgtccgatttgaaaaaggaggtaaatcgtcatgaaaaatcaaaaacagagacaaaatgatttttcaaaaacatcaaaagtcaaatttggcattttgaccaaattgctgctgggtatcatcacccctctggtaattgtgcttatcatcatcggtcttcagctcaacagtgggatgtcaaatacggtaaaaacactggatacaaactatttaaccgcagaatccatgcgcgcatctcagcaaatcactgcttatttccagcggtttgtagggatggcaaatctggcttcccagatggatgaaatcattcgcttttccgggcggcagcccaatttgaccgggacagaggagcgtaatgaactgttaacgactttgaaaaaaattcagtccgccgatgacaccattgcttttacctggctttataacataaattcaaaggattttctgcaatcagacggcacctataaaaattccaccacattcgatgcaaccagccgtatctggtataatcccgtgataaattcggaaaaaacgattgtgactggcggttatgaggatatcgcctccggcaagctgatcgttacggttgcaacgcctgtttatatcaatgggaagatgacgggaattttcggcgttgatgtgctattggaacatttaacgtcggaactggccaagattacgatcggcgacacaggatatgtcactgtatttgacacggataataatgtcatatttcatccaaacgctgacctgatcatgaaaaatgtttccgatattgcatactcggataatgttaaggaggctattttaaacaatcaatccgtcgaggggttgcaatacacacgcaatggagaaacgtatttcggatctacggtctatctaaacgatgttgattattttgttttgggactcctgccgtatgcggaatatcaggcgtatataaccgataccacaaaggctgtcgtcctgtggttcgctattggtattttgatcttagccgtgataatcataatttttagtttgaacataacgcggtctgttaaaaagctctccgttaccgcaggcaaaatcgccgatggagatttggacgtgtcaacggatatatcctcccatgatgaaatcggccggctttcgcaggaaataaacgcgatcacaggcagactgaaggagtatattttatacatcgacgaaattacggcggtattgggagaaatcggcaagggcaattttgtttttacgttgcagcaggattataaaggcgaattcgcaaaggtaaaaaccgcgcttctggaggtacgggataccatctcgcgaaccttgaaatcggttgtcgtcgcggcagaccaggtcctcagcggcgccgaacaggtagcgaccggagcacagtcacaggcccagggcgcgacagagcaggcatccggagttcaagaactagcggcaaccctgcaggatgtttctcagcagattgacagcaatacggcagccatccaggaaaacggaaaagatgttgagcaggtagccgaggaagtgcatgagggcgaagaaaaaatgagcgccatgctggaagccatggattcaatttctgaaaactctcaaaagatcgaaaatattattaaaaatattgaggatattgccttccaaacaaatatattggccctgaacgcagcggtagaagccgccagagcaggacaggccgggaaaggctttgccgtggttgccgatgaagtgaggaatctggcggccaaaacagcggaagcgtcaaaaacaaccgccgagttaatacagcaggcattaggcgccgtcgggcatggtaaaacaatggcggatgaaacggcattgtccttcaggcaaatttccgaagctgttaagcggattgctgaaaaatcacaatctattacgttaaattcacaaaaacaggatgaagcgatcaggcagaccgctttgggtgtagatcagatatcaagcgtcgttcaaaccaattccgctaccgctgagcaaagcgcggcggccagcgaggagctttccggacaagcgcaggaattgaaaaaccttgttgccaaatttcagcttccggactgcgcggcgcctgtttcccaagatacgctttcgttcgaacagatgtcatatccgcagccttcggttctttatgactccaaatattaaaaggcgcttcgaaccgtcgtcatatccttattagtcagcgtaacaattccggcatactggaagataaggtgcgagcagcctttttcttccgatcggacagtcgggcaaatattgacaacacggctgggccatgctatgatgaatatataattaaatcgtggggagcttgcagacaggctgagaggaaactgtgcgtttcgacccgtatacctgatttgggtaatgccaacgtagggagactttgctggattcagcgggacatgcttacgcgcgtcccgctgttttttcgtttccgcacggcagcccgcaccatcaaagaaagaggctgatcattatgcaaacaaacgtcaaaaaactgactgtcgccggcgtccttgtcgccgtgggcgtggcgtgttccaccttctccattccggtgggcgcgtcccggtgctttccaattcagcatatggtcaatgtaatcgccggcgttctgctcggtccgctttatgcgtgcacaatggccttttgcacctcgcttctgcgcgttctgctcggcacgggcagcctgctcgccttccccggcagcatgatcggcgctctgtgctgcggactctgctacaaagcgagccaaaagctgccgctggcttatctgggggaaatcatcggcaccggcgtgcttggcggcatggcctgctaccccattgcgacgcttgtgatgggcaaggaggcggcgctgttcacatatgtaccggcatttttattaagcacagctgtcggcgcgactatctcgattctggcaatcggcgccttgcagaaaacgcgcgtgctcggccaaatgaagcttgcgctcggccgcaaataaaaacggagggaatgcagcatgtttgaagaaatcctgcaaaacgtagcggcaaaagcgccgctcgtccactgcataacaaattatgtaaccgtaaacgactgcgccaacatcctgttggcctgcggcggctcgccgatcatggcggacgacgaaaacgaagtcgaggaaatcacctcgatctgcaatgcgctcgttctcaatatcggtacgctcaatacccgcaccattgaatcgatgcgccgcgccggcctgcgcgccaacgcgctcggccatcctgttgtgttcgaccctgtcggcgcgggcgcttccgcgctgcgcaccggcacggcccaatcgctgctgcgcgatgtgcgtttctgcgtcgtacgcggtaacagctcggagatccgcacgctggcgcgcggcgccggcacgacgcgcggtgtcgacgccgacgcggccgacgccgcgaccgagcagacgcttgacgacgctgtgttgtttgtcaaaacgttttccaggcagaccggggcggttgtcgccatgaccggcgcgatcgatcttgtcggggatgcagaaacctgctacatcatccgaaacggctgccctgagatgggcaaaatcaccggaactggctgtatgctgacggctgtcactgcggcctggtgcgctgccaatcccgaccatccgctcgacgctgccgccgcagccgttgctgcaatggggctgtgcggcgagctggcacacgcacgcgcccaagctgccggcggcggcactggcacactgcgcatggcgctcatcgatgcgatgagccgtcttgacgcggaaactttgaacagggggattcgcattgaaagtcgatagccgttccatgctgctttatgctgtaaccgaccgcgcctggctgcgcggccgcgcgctgcccgctctggttgaggacgcggtgcgcggcggcgcgacgttcgtacagcttcgcgagaaagaaatggagtttgccgcatttctcgatgaggcgcggcgtgttaaggcggtcacagaccgctatcatgtgccgtttgtcatcaacgacgatatcgaagttgcgcgtgcctgcaacgcagacggcgtacatataggccaggacgacgccgctgtcagcgaggcgcggcgtatccttgggccggataaaatcatcggcgtctccgcacatacagtcgacgaggcgcgcgccgccgagcaagccggcgccgattatctcggtgtaggcgccgtcttttctacctcaaccaagctggatgctgatatcgtcacgctccagacgctgcgcggcatccgcgcggctgtttccatcccaattgtcgcaattggtggcatcaatgtagaaaatatgctacaattgaagggcagcggtatcgacggcgcagcggtcgtctcggcgctatttgcgcagcaggacgtttacgccgccgccaaacggctgtatgcaacttcaaaggagctggttttcggttgatcaaaggcgcgatttttgatatggacggtacgctgattgattccatgcctctatgggaggactgcggacgggcctttttatccgcgcgcggcattactgcgcgtgacgatctgggcgaaacgctcaaatccctgtcgatggagcaaacggctaattatttgcgggacgcatacggtatttccgagacaacctctgaaatcattgagatgatcaatggaatggttactgacgcatatcagcgcaccatcccgcttaaacgtgacattgccgcgtttctcgagcgcctcaggcaggcggatgtgcgcatgtgcgtcgcaacggcgaccgaccgtccgctggtggaggcggcgcttggacgccttgacctcctgcccttttttgaacggattttcacctgttcggaggtgggggccggcaaggaccgccccgatatctttgagcaggcgtgcgccgcgcttggcacgccgcgcggcgaaaccgtcatctttgaggatgctctttatgcgattgaaacagcccggcgcgccgggttccgcgttgtcgcaatcgcggacgacgcctccgccggcgacgaggcgcgcatagccgcactgtctgagcaatatatacataactatgaggaatgcgaggtaaacagtttatgaagcgggttttgaccatcgccggaagcgattgcagcggcggcgcgggaatacaggcggatatcaagacgttttcggcgcacggcgtgttcggcatgagcgccattgtcgcggttgtggcggaaaatacggcgcgcgtcatcgacatcatggatgtcacccctgatatgattaaaaagcagatcgacgccgtttatgaggatatcggtacggacgcagtcaaggtcggtatgctgtcacagccgtgctgtatggccgccgttgcggaaaagctgcgcgagtacagcccgtccaacgtggttatcgatcctgtcatgtacgccaaaaacggctgcccgctgatggagccaggctcaatcaatgcgctgatcgaaacaattatccctttagcggacctgctgactccaaacatcccggaagccgaaaaaatcgccgggatcgttattcattcgaccgccgatatggaacgcgccgcaaaaattatccgcggcatgggttgtaagcatgtgcttgtcaaaggcggccatgccgccggcgacgcgctcgacgtgctttatgacggtatacagttttatcgcttttcgacggctcgtatcgataccaaaaacacgcatggcactggctgtacctattcgtcggccatcgcctcaaaccttgcgctcggacacgatatgcctgaggctgtcgcacgcgccaagcactatgttacgacggcaattgcgcacgcgctcccgcttggcaagggctgcggtccaacgcatcatttttgggaactttatgaacatggcttgtcaaatacgaccggttgacgaaatacaattttacccgcattgtcagagaaaaaactgccgaaagcgaaaggaaacgcacatgcgtttcctttcgcttttttgcacttaaaatagactgcatatttagtattaatcaataaaaaactgttttcttattgacaatagatcctatttgcgatataattacaatcaatacaagatattattactaatttataaccttgttaatcggggatcgttcccataaatcacataatcaggaggactacaatgagaagcattacaacattggacctgcagtacgcgcacagattttatggcttcaagggtgaagcccagtatttgcacggacacacaggcgttctgaccattgaggtcgaggattccatcgaaccgggcgtcaatatggtttttccctgcaacgaaattcagaaaaccgcttgggaagttttgaaaaattttgaccacgcattggtgctgcgggaggacgaccctctcttgcctgcgattcttgacgtttataaggcgcagggcatccgcgatggcgcgccaaacaacaagatgatgggaccggctttcaaaacggagcttgcgaccgcatatccggaatgccggctggttgtgacaaaggaaaccatgaccgttgaaggtatgataaaaattgtttacagcctgctgaaggataagctcaatatcgccaaaatcacctttaccagcggtgtaaatgccgcctcagagaaatttgagccggcaaataaaattgatcgctgcccactgtgcggtattgcgctgaacgaaaacggcgtatgcccgaaatgtggatacaaaaagaagtaaataaaacggcgccgttttatagccgctgaatgaacagaacgctgctcccgcgggagcggcgtcctgtcttttacacaaaacagcggactgtatccccgcgcttttccttctctgccaaattgacgcgcggccatttcttggctataataacattagttgtttcgcggcggctttcggtgtcaagaggccctgggctaaagacagtccggacggccgattttttatagatagctccgcagcgtattacaaaccattctcactggagggaagcggatgaccgattttctggtgcgccggctgattaaggactgcggcaatatcaacgaccctgctgtgcgcgcccgttacggcgcggtcgccggcggcgtcggtatttttttaaatctttgcctgtttgccgcaaagttcgcagccggtttgctgacagcctccatcgcgataacggcagacgcctttaacaatctttccgacgcgggttcgtccgttgtaacgttcgtgggctttcgtatggcgggtgcgcccgcagaccgtgagcatccgttcggacacggcaggattgaatatctttccggcttggccgtatcggtggctatcctgatggttgggctggaactggcgaaaaattcctttctaaaaattctgcatcccgaggcagtcgccttcagcacggtgtcgtttgcgattctgattgcttcgatcggcgtcaagctatggatgtgttattttaaccgcgcccttgcccgccggatcaattcctctgcgatgcgcgccacgtcgatggacagtctgacagacgcagttgcgaccacgacagtcgcggtcggtattgtcgtaagcgcggtatttcacatcaatatcgacggctggagcggcatggctgtcgcttgttttatcctctataccggatatacgacggcgcgcgacagcctttctcccctgctcgggtcgccgcccgacgccgattttgtccatgatatagaacaaacggttctcgctcatccggaggtcagcggtatccacgacctgatcgtccatgattacggcccggggcggcgtatcatttctctgcatgccgaaatgccatgcacctccgatatcctcgccatgcacgacgccgtcgatgtgattgagcttgaactgcgccacaagttcggctgtgatgtgaccattcacatggacccgcttgccccggaagatgatgaaacacgcgcgctgcgcgaccgtgtcgctgatttggcagcgcagatcacgccggaggcgacgatacacgattttcgggttgtcaaagggacgacgcataccaatcttgtgtttgatctgcttatcccgcacggctgcccgattgcggaccggcagattgcggaccgtgtgcgcgagggtgtgcgtgcattcgacggcaattttttcgcggttgtgcgcatcgacaagggatttttgtaaactgtctgaaaggaagtgaaacaatgagccaaaatagcgaacccatccgttatgaggacccgctgctgcgtctgattgatcaggggatctccgaaattcgcggcgacgacgaacttgacgaaacactgtctgctatccgtgacgcacgcagcgacaagccaaaggacgacagccgccagtcatagctccatcagacccgccggaacctgctgttccggcgtttttttccatcttccgtcattgcaaatttgttggatttgtattaaaataatgattataagccacccccataaataccccctgacaggaggattcatggctgattcaaggatcacaaaacgggccttggccgcatccctcaaggaattgatggaacgtactccgctcgccaaaatatctgtcggcgatatcaccaaaaactgcggcctgaaccggcagacgttttactaccatttcaacgataaatttgatttagtcaactggatttacgcaactgaggccgcgccatatttggagcagttttccaaccgtgagcactgggtcgaggggctgtgcgcgctttgcggctacatgcagcaaaacagcaaattttatatcaacgccttggaatactccgggcaaaactcgtttcaggattacctttctgacatcgcgcatcagcttgtgcggacaatggcggatgagctggtcggcgggcgcatgatcgatgacgctgaaatggaattcatcgcggatttttatgcgtgcgcctttgtcgggctgatcatgaagtgggcgcgccacggcatgcgtgagaaacccgaggactatatcgatcgcgcccgtatgcttgttgagggcagtctgcaatatgagatgggacgccggtaaacaactgaaaagcacagccctatgccaagccgccaagcggctggcatagggctgttttgcatcgtcctgtttaccgccgcgcaaatcgaacagccaaattgcactccgtttttttcaaaagggcttccctgtcgtattttttgacagatgtaaaaactgtctagagactttttttgtcttgtgtgctatgatcatttaccagaaagagaggaaccggccgaagggcagttcctttggacggcgcagggcgccgccggaaagagggggattttcattgatcaagcggtttgcgcgcctgttgacgcgcgcgccgaaaacggttttgtttcttgccttactgatgcttcttccaagtctgtacggagcgatcaacacacgtgtcaactatgacattttgtcctatctgcctgatgatcttgactccacacgcgggcaggcagtgctggaggatacgtttcacagcgcggcgaccgcgatgcttgtaattgaggggatgccatcccgggatgttgaaagcctgcgcgacgctatcggcgagataccaaatgtcagcagcgcgctctggatttcaaacatcgccgacatcagcgttccgaaggatatcctgccggacgcgatcaaggatgtgttctacagcaaaaatacgccggatgccacaatgatgatcatccagttcgaccatcccggcgcgtcaaatgaaacgctcaaagccattgacgatatccgtgcgctctgcgacaagcggtgttttttggcgggtgtatccatcttcctcaaggacaccaaggatctggtcgagcaggaaatgccgttttacaccgtgctggctgtcgtattctcgattgcggcgatgctgtttacaatggaatcgaccgttttgccgtttgtatttatcatcggtattggattcgctgttgcctataatttcggcaccaatctatttctgggggagatctcctacataacaaaagccattgcggccatcctgcagcttggcgtatcgatggattattccatctttctcgtcgaccgctacaacgaggaaaagccaaagttcgccgaccggcgcgacgcgatggcccgtgccattgaaagcgcgtttgtctctctttccggttcgtcgatgacaacgatcgccggctttctcgcgctatgcgcaatgcgcttggggcttggtccggacctggggcttgttatggccaaggggatcgtgatcggtattttggttgtgctcgtcgtgcttccgtcgcttgtgctccagtttgataagctgattggacgctggcagcataaaacgcttgttcccagctttgcgcgcctgaacgactggatcatagaccaccgcaaaatttttgtcgccctgttcctgatcctgttcctgccggcctggtttctgcaaagcaaaacggaaatttactacaacatcgatcaatctctgccggctgatctcgcctcaactgtggcgaccaacaagatgcgcgatgaatttgatatggcaaccacgcacttcatcattgtcgacgacagtatgccggcttaccaaatgcggcagatggaggacgagatccgcaggacggacggagtcgcatcggtgcttgcctataatgaatttgtcggcccgggaatacctgattccttcattccgcaggaagtacgcgacatctgtaaaaaggacgggatgcagatgatcatggtcaactcccgctacaaggctgcgcgtccggaggaaaacgcacagatcgatgcgctgactgaaattgtcaagcgatatgatccgacgggcctgatcaccggcgaaggcgtcatgacaaaggatttaagcgatatcacaacggtcgatatacaggtgacgaacatgctttccatcgcggcgattctgctcattgttgcgatctgctttaaatccgtcaccatccccattgtgcttgttgcggctatcgagctggctattttcatcaaccagggaattccggcgctcaccggaacagtcatcccgtttatctccccgattgttatcgggtgtatccagcttggcgcgacggtcgattatgcaattctcatgacgacacgctttagggaggaactggagaacgggcttgaccgtgtgtcagccatcaaggttgccgcaaccgcctccgataaatcaatcatcacaagcgcatccgttttcttctgcgccaatatcggcgtcagcctcatttcaaaaatcgaaattatcaagagcctttgctccatgctcgcgcgcggcgcgattatcagcgccctgatcagtatttttatcctgccgtccattcttctggtctgcgaacggttcttcgccaggacctcacacggatggcccaaaacgggcgcagcgggcaaatccaagctaaaacaggaggaatccatatgaatcagcgggggctaaaagccgtcagtctcgtgctggccgcggctataacctgcgcgtccgtgctttccggctgcgcgaagtcaaacggcacgcagagcaccgccgcatccccggcttcgtccgaagccgctcaaacagaccaacaggtcgtctccgggccgttcacaggaccggacgccgccggcgtcaaaaaaagcgaaactgtctttatcaatcttgacccgaccggcaaaccatatgaaacgacggtcacagactggatccacagcgatacgcctgacgccgtattaaacgacctgtccgacctgacaggcattgaaaatatcaagggattgcagcagccccgccaggagggcgatcgcctgacatggaaaatggagggcagcgacctgtattacacaggtaaaactgacaaggaaccgcccgttgatgttgaaattacatatacacttgatggcaaatccatcgagccgcaggagctgccgggcaaatcaggacaattgtccatgacggttcggtttcgcaatacacaaaagcagcgcgtgaccatcgccggcaaggataccgatatgtatacgccaatgctggttgcggcaggcatgtcgctgccggacgataccttccaaaatgtcgaggtcagcgagggcagcgttatttcagacggcagcaaccagatcgtcgcctttgcgtgcgtaccggggcttaacgacagcctggctctcgggacctatcgtatacaggaaatcaatgatttggatttcccagaggaattcactgttaaagcggatgttcaaaattttgaaatgggtcctgttatggtcgccgtcacacctgagcttccggatcttgacgaactgacaaagagcgatgaatttgacgatatgcgccaagacctcactgatttgcaggatatgcaggacgatctgaatacaatcgatcctgaccgcgacattcgctcgcttctgactgatccaaatcgtaccgaagcggcgcgtgtgattacaaacgatgtattcgatttttatgatctcaataaggatctgcttgatatccttcccaaatatgtaactgatgaaaatattcgcctttatgaccgtatccggcatgatattaaggacggagcgttcgattccctgctggatgatgatgagcttgccgatctgatcgatctggtcgacgatttaagccccaatcgcttgcaggagcttgccgacgattacgccgagctgcaaaaaaacgataagctgcgcgcggcgcttaaacagcttatgggcgcagccaacccggacacagaaaagctgcttgatcttttgatgcaagtatatggcgcaatcaacagcgacaccgccgtcaaggaggctggactgaccgcgctcaacgggctgatccagcgcccggagctgttgaccgcgagcgcccaggcggccttgcggcagggcgtgcgcgacgcgctgatgaaatgcatcaatgtccaggagcagacggcagccggtatgcttcagatggtactagcacaatcaaagctgaattcacgtttgcaggcagaacttgtagccgccagctacgccgggctgattgttgatccgtccaggacgcgtgctattcgtcatgccgatgacgttgcggacgcctcctccatcctggacgaggacgtttcctccgcgcctgacgaggatgcttcctccacacctgacgaggatgctccctccacacctgacgaggatgctccctccacacctgacgaggatgctccctccacacctgacgaggatgctccctccacacctgacgaggatgctccctccacacctgacgaggatgctccctccacacctgacgaggatgctccctccacacctgacgaggatgcttcctccacacctgacgaggatgcttcctccgcgcctgacgaaaaggctccgactgtctttgaatcgataaccgaaaacacagttgtcaatagaacgcggacattggctgcattcacaaataatgcagacggcgacacgtcctctgcgccgaacgatggcacgtcctctgtaccgaacggcgacacgtcctctgcgccggacggcgacacgtcctctgtaccgaacggcgacacgtcctctgcgccggacggcgacacgtcctctgcgccggacggcgacacgtcctctgcgccggacggcgacacgtcctctgcgccggacgacgatacgtcctctgcgccggacgacgatacgtcctctgcgccaaatgatgatacgtcctctgcgccatttgtcccctccgagccaatcaaaccgcttgcctccgaccgcgccgacctttacaaggaaattacaaccgatacaaatgccggttattatctgattgaaggtgcaatcgacgcatatgtgaacaatgccgatccagccgagctgcttacgctggcaaagcagttcgacccacaggctgccagccaggtagaaagtatgcaggccatacaggcgctgcttggtcaaattgggccggatcgtctcacttccctgctttcgcaggctcagacatgtgaaaagtacctctccgatctgttgacagcggttcagcagcctgagttgaaagaatatctggaaaagctgatgagggaccttcaggacaacgaagaaaacctgcataccctgatcctgcttctcagacagcttgatgacatgaatctgcttgacgaagtcgaaaacatcgacgacctgcgtgaggacctttccgatctgcgtccgattgtacaatcactgcggcgtgatctcgaccgggcagagatgaacaagagcctgcacgcttcccctgaaacggtcgataccctactgcgtatgaaggacgacctggaggaacaccgcgatatcatggaaacgatgcgcaacatgctccaggaagaaaaagtaaccctttctcgcagcatgatcgcaacgcttgaccgcctcgaggccaaagacgcggcaggcagcgccgtggaaaagcttgacgatcttgacgagctgcttgaacgcaaggatcgttataccgagctttcagacgcataccgtattttcacggccgcgccagacagcatggataccgatgttaaatttgtaatgaaaacggatgagatcaagctgcccgatgatgatgaacccgtccagacgcctgtgcaggagcaggaaggttttgtcgcctggttcaagggcctattccagtcctgacatagtacaccggaggctgtctgatcagacggcctccggtgttgtatctgcgtttgtacaaattcgcggctgtttaaaaaatttttccgacttttttacacagcggcggattctgcgttaaaaagcgccttgcaattcgaaagtttcctgcgttttttgccttgcgtttttctgctgtttgtaaacatttaagcaattcctctattttcaaacaagctctaaaaaaacaccgggagcttcacgcttccggtgttttatatgttactcctcccaaagagccttcattttctgacggatgcgcgcacggcggcgttctgtttcctcgcgatcgattcgaaaagctccaagctcatgaacgaccacgtcgccctcccccgcttcacgcggcaaacgcgcacgttccatcccggtatattccccattctcggcttcaaggattgcaaaattcccttcaaagcgatctatgatatattgcatcggattcacttcctcattgacgcaaagcttttaatcaactcaaccgcaccatctgtgctgattacactgctatccaatgttaaatgatagccctcaagatcaccccaccgcttatcggaataggaattataatatgcggcgcgttttttgtctgtttttacaatcaattctttcgcggcagccgtatccagattgtgacgctgcttgacgcgtgcgatccgatattgcagcggcgcatgaataaatacgttcaaacaatccggttcgctgcgcagcgcatagtcggcacaccgtccaacaatcacgcagtcgtgctcgcgcgcaatgcgctgaattgtttcaaactgcgccagaaacaacttctgattcagcggaagcatattggcgcccgctatattccccactgcatatggattgactgatagggaataaagcaaactgctgactggcttttcatcattattttcaaataattctacactcatgccgctatccttcgcggcagcaacaagcagctcccggtcataatacgcgatgccaagcgtactcgccagagcctgcccaatttcgcggcccccgcttccaaattccctgccgattgtgatgatcgttctttttgccacgctgaccgcccctttccatttgccccagttaaaagctggctggcaaccagccgtttccctatttaaaccagctttatgttatggggctccttgaggatattatacaccctttcagccattttgtacagtctcataaggccgtattcacaaaggtcgcaccaggggctgtttaaaaaaccgaaacgcgggaggcaaatgcctcccgcgctacaaatcccatatcagaccgcttcccgtggttccggacggaacagaagcgagacgcaccaaatcgcgccaagcgcgacaagcgtatacacaatgcggctgaaaatgcttcccgaaccgccgaacacccaggctacggcatccaactggaaaatgccaaccaagccccagttcaggccgccaatgatggccaggatcaaagcaatcttatcaatcatgttaaaaaccctccttcttttgattaaggcttaattgaaaacagtaaatttaccggatttcaacagcccttaggatttttcatcgatagtttgtccggaaaatatcggatttatacagcgtacacgcaactgaggacgattctgatgcggcacaagtgaaaatggcgctgcgccggccacggcaggttcacatgcaaacaccatgactttctccacctgctcacgcgtcaatgtacgatatggcgcgagcggcgctccctcataaaagaggactgcacgcccatcctgcggtgtaaaagtaaaggttaaagcgtcaaacgaaccgatctgtttctccaacgcctgcgcattcaaccggtatggtccacccgcgggcaatgtcacaatccgctgtccatccgccgcactgacacgcacgccgcaaaacatcgctgtaccgaatgcagttaaaattgccgccagccgtttcataacagcatcccctttttatgatcattgctttggttttattgttgccggttgatttgccgaatatgacggctatcatgaattttaagtttttttgagctgggattttttacaggagagatatcagccggatgtatccgcttgttttttttcactgtttatggcaaaataaacttatcaactgagaatcaaagaaaaggatggatgaagcatggaccaccagaccattgtcgtacttgactttggcgggcagtataatcaactgattgcgcgccgtgtgcgcgaatgttccgtttattgcgaggtgctcccctatcgcacgcctctggaggaaattatcgcaaaaaagccaatcggcattatcttcaccggaggtcccaacagcgtttacgccgacaattccccgcgtattgaccgtgcgatctttgaacagggtatcccagtacttggcatttgttatggcatccaattgatggcttacacgcttggcggccatgtagttagccccgatacccgtgagtatggcaagacaatcacatattatgatacggaatgtgttctatttaaggggcttcccaagcaaggaatttcctggatgagccataccgattatatcgacgctctgcctgccggatttaccgctacagcgcataccgaccgttgtccgaccgccgctatgcaggaccccgtacataaattatatggtcttcagatgcaccccgaggtgcttcatacggaaaatggtattgcgatgctgcgtaactttctttatgaagtgtgcggcgctatgggcgactggaccatgggcgattatgcgcagacagctattgatgcgcttcgtcataaaatcggcagcggcaaggtattgctcgcactttcgggcggcgttgacagctctgtcgcagccgcgctgctttcccgtgccgtgggcaagcagcttacctgtatttttgttgatcacggcctgatgcgcaaaaatgaaggggacgaggtcgaagcggctttcgcggaccgcgatatccattttgtacgtgtcaatgccggcgaacgatttctcggtaaattagccggcgtcgatgatcccgaacgaaaacgcaaaataatcggcgaagaatttatccgtgtttttgaggaagaagcaaaaaagatcgggcatgtcgattatcttgcgcagggaacgatctatcccgatgtgatcgaatcaggcgcaggcgatgcggctgttattaaaagtcatcacaatgtaggagggttgcccgactacgttgattttaaagagattgtcgagccgctgcgtttattgttcaaggatgaaacgcgcgcacttggacgtgaattgggactgcccgattatctcgtcgatcgtcagcccttccccggccctggccttgcaatccgtatcatcggcgaaatcacacctgaaaaagtttctatccttcaaaatgcggatgcgattttccgtgctgaaattgcaaatgccgggttggaacgcgatattcatcaatactttgcagtattgacttctatgcgttccgtcggagtcatgggggatggacgcacatatgattatacgcttgccctgcgcggcgttacaaccaccgattttatgacggcagactgggcgcgcatcccatttgagacgcttgatcttatcagccgacgcatcgtgaatgaagtacgcggcatcaaccgtatcgtttatgatatcaccagcaaaccccccgcaactattgagtgggaataagcaaaaagtggatatgcgggcccgcaaagccgcataaacactgggtttttgattttcaaattccccgtttgatagcagattgatagcactcgtcaaatccatacttgctgattttctggcaggtaacaggtggtttgcaggtgcagattaaaaacttatccaagagaaaaggtctaaccgatttttgcaagtcggttagaccttttttatttatcctttttgtccttgttcagctcctctaccagcatatcgctgaggccctgagaagggacaaccttgtgccaatggcctgtagtatcgaactccgggtagcgataacgccagcggtcatagtcctctttggtgatcgcccccgacttcaacttggccgcctgctccccccaagcacagagcatctcatggagccttgctgcatccttgccctggaacacatccacccgaagatgtatttctccatcacactcgcagattttcagtccgtagcggtcctcaagcgtgaacagcgtgtgcataagacccacataggagtcgatgtccggcacagccagggcatggggagagacctccaatatctgtgccagcgcggcagtcagatctgtcttgggcgtccgcgacccgttctcatattgagcaaggcgcacatcggcagacttctccgggaagcccagcgccataccgagatatttctgcgtcatgccgcgcagagtacggaaaaagtgaatgcgttctccaatcgccataacggccaactccaatctggattcttgataattttagcatagcagaaatgcttaggatagtcaagagaaatctaaacaaatttatttaatatttttctgcaaaccacttgactttaactgttatgcttagtataatgaaggtgatataagcaaataagtttaagtcacaaaaattttacaaattagatacccgtcaaacggcaaaaaaatgtccgttgtaaagtgagagggggaatttcagacgaagcaaaactgaatgaccgtccgacagatactttctccggggaagcaggcggcgacatgagcgtgccaaggagaaaaacaaacggcacagcgccgggaagggttgcctgccagagtctgaagggtgaaacggcaaacaagaaacgatcacgacaaggaaaggaaggtgtttttgcgtatggcaggacagatttttatgcgtgtggacgaagtagccgaggaattggaggtatctaaaccctacgcttataaactcattaaacgaatgaatgaggaactggaacagactggctgcatcacgatcgttggccggattgaccggaaattctttcatgaaaaattctacggtacaaggactgaaacgaaaaggagggagggctaaatatggccgcattcaaaaataaagacaacggaacctggtatgttcagttccgttacacggactggaggggtgagcgccagcagaagcttaaacgcggttttgcaaccaaaaaagaggcgttggcctgggaacgggaattcctgatggagaaacaggccgatataaatatgacatttgagagctttgtttccctgtacgaaaaggacatcaagcccaagctgaaactcaacacctggcttactaaggaaagtattatccagaagaaaattctgccgtatttccgcaagaggaagttgtcggagatcacggctaaggacattattgactggcaaaatgaaattcgcaaccttaccgactgtcacggaaaatctctatccaagacctatctgaaaacggttcacaaccagctaagtgcaatcttcaatcatgcaatccgctactacggtttgcaagtcaatccggcacagagggcaggaaatatgggaacagaagaacggcgggaaatgctgttttggacgcgggaggagtacacaaaattttccgaggccatgatggataagcccatttctttttatgcctttgagatgctttactggtgcggaatccgggaagaggagctgctggcccttacctcgtcggatttcgactttgagaaacgcaccctcaccatcaataagtcctatcagcgtctcaacaaacaggatgtcatcaccacacctaaaacgccaaagagtaaccgtgttatccagatgccccaatttctgtgcgatgagatacaggactacctcaagcaactctacggtgtggaaccggacagccgcattttccctgtcagtaaaaactatctccaccgtgagatggatcggggctgtaaagaaaccggggtaaaacgcattcgcatacacgatttgagacacagccatatcagcctgctgattgacatgggatttaccgctttggcaatcgcagaacgggtagggcatgagagtatcgacatcacctaccgctatgctcatctgttccccacccgtcaggtagaaatggctgacaagttggattcgctgaaaactgagaaaggagcttaaaacaatgtctatgaaaaatcttgaccgccacaaccgttggcggaacaaaacggtagctttccgggtgtccccgcaggaggatgagcagcttgaaattttcgtcaagttgtctggcctgacgaaacaggactacatcactcggcggctgctggaaaaggacgtggtggtccagggcaatcccagggtatacaaagctttgcgtgaccagcttgccgctgtgctggacgagctgcggcgcattgaggctggtcagagtgtgaacgatgagctactggacaccatccaaatgattgcaaccattatgaacgggatgcaggaggatactgcctatgggaattgacgcaaaagaaaagactgccccaaacacatctgttggcgcagatgagaggcagtccattcaaaaagattctgataacagtatacccgcttcggaggaaaaacgcaacggggaaacggaaaattctacggaaagtctggaagaaatataccgtaagatgcagcgtatggccgacccgcgctacctgcacacgctcaccatgaccgagctgtttcagacctcctacaaaagccgcccgcccattattgaaaatttgctccattcaggggcgtaccttctcgctggcgctcccaagatcggcaagtcgttcctggttgcgcagattgcctaccatgtcagcaccgggcaggatttgtgggggtgcaaagtccatcagggaacagtcctttaccttgcgttggaggatgacttccagcgcatccagaaccggatgtttatgatgtacggcgtgaacgatactccccatctgcactttgctaccgctgctggaaaaatcgggaacggtctggacgagcaactggaaaacttcatgcgggaacattcagataccaagctcatcatcattgacaccatgcagaaaatccgggaggtcggcggcgaggcgtacagctacgccagcgactacgagatcgttggtaagctcaagcagtttgcagacaaacactgtatttgcgtgctgaccgtccaccatacccggaagcaacccgccggggacgctttcgagatgatctccggcaccacgggcctgctgggctgcgcggacggttcactgctgatgcagaagaaaaagcggaccgcattggaggccaccattgatgtggtaggccgggaccagcaggatcagattctctacttgaaaaaggacccggaaacacagatctggaatttggagcgcatggaaacggagccgcacaaggaaccgccggaccctgtgctggaagcggtggcccggctggtcaatgccggtcaaccggagtggacgggctctccctcggagctggccgcagcggtgcaggtgggcatggcggcaaatgcgctgaccaagtacctgaatgtcaaatccggcaggctgttggaagaatatcatgtaggttacgagaatagggcgcggcacgccggacggcaggtgaaactcacttatatgctggtggaggctccggcttttgaagtggttgaggatgggcacgacggtagcgacggttgcaacggtgaaaatgctgccgtccaaacaaccgtcgctatcgtcgcagccgtcgcagaaaggaacggaagcgaatgaagaatgtgcagatttcctatgacttgttcgtggcgctggtggagtatcacctcggctatgatgatgaatacgaggatgaaatccggcagggattggagcagaagctggacgccctggtgcggcacgagttgtacgccaaatataagactgctcccagcgcggaagaacgggagcaagctcggcaggcatacctggaccggcgcggcgtattcccagattttcgctggtaacagggatttactttcgtactaatcccgcaaatgaaattagcaccaaagtcaatcttctccctgctggcatggacaggagcgtgacacgctcctgtggctggcggacaaggtgaattgaccatcaacacatcttccgtatctcccgtccccattggaaaatccgcagatttggagatggctaaggccgggagaatccggtggattttcccggcctgtggacggcggaatcgaagcaaacggcagttgcgaaaaggccgccggtcacaccacattttgaggctgtgggtatcacctgcaagccgaaaaaggcggcgaggctcccgcaggagccgcactccccctcggagagcccacgatactttgcagccgcaggatgaaagtatcatagtgggttattacacttccgcagaagtgcatccccaaaagctacccgcatctcaagcgcccttatggggcgagaaaggagttctatggcaagaggcgacggtatccatcgtaccagcgcaagaaacatgagactgaccacacccaaactgaaaaacgcgcagcagcacaacgagcgcgaaaaagaatcgtatgtcaaccaggatatagtcccggaacgctcccatctgaatgttcacttcaaggaaccggacggcggttacttggaacagtttgaacagatggaggccgatggaatcatctccacgcgcggtatcaaggaggacgctttccgctacggtgagttgattttcgatgtgaactccgcctactttttcaaccacggcggatatgacttcgcaaaacaattttaccacgacgcctatcaggctgcaatcaaaattgtgggcggcgaacagtacatcctgtcggcggtcatgcatgccgacgaacgcaaccgggctatgtccgaggcgctggggcaggatgtgtaccactaccatctccatgtggtctatgtgccggtggtggagaagcaaatccgctggaccaaacgctgcaaggacaagtcgctgattggcaaggtaaaagaaacggtcatgcaggtcagcatgagtaagaagtgggcctctaagccggttctagatgaggccaccggcgaaccgctgaaaacggcaaagggcaagcctgtccttagaaaatcgtacagcgtgttgcaggacgatttctttcggtatatgcgcgaggctggatacgcggatatagagcgcggtgagcgcggcagttccgaggaacatctgacggtgacgcaatttaaggtggaaagagaacaggcgcggctggcggagctgcaaacagaaaaatcagaggttcaggcggagatcggccagcttcggacggataaggccgaggcagaaaaatctgccaaagaagcgcagacggaactccggctgctggctcccaaactcaagagcatggagaagctggcagctgagtattcttccgacccggatgacctgctgccactccccgatcgaatggagtccgccaaatcctaccgggagaaaaagtccaagccgctgctggagaagatcgtcaaggtgttgcgctccgtttaccgggcttatctggatgtctgccagaaattcgagctgttgcagcgcaaatatgatacggaggttccgtatttgaaaaagcagttggccgaggtcagggacgaaaatgcggaattgcaggaaaccgccagagactatgaccggctgtgccgagcctatgggccggagcgggtagctgaaacggttgccgctgtcaagcggcaggaacaggcagagaaagagcagaaacgcagtcaaaaacggcggcatgaccgggatgagcggtaatcccgtgtagagctgagaaacgctgatttttgcggatagagttacctgaactgaatcatgtatcgtttgggtgctttctatccgaaaatccgcttacttttgccagtgtagagccggagaaaatttgtgaaaatacggaggttttatgagaacaggtctttccaagaagcaaaagacaaccagtgtcttttttgacgaggcaagccccatcattgaggtgtttacctacaacacttccctcaaaaagaggttaagcgagtatgcggcaaagtatccggtcgagtgccggttggtggatgacgatgagaacggttgcctcacattcgagatcaggaaagggcggttcagtttcaagctgaacgcaccatacagcgcagagcgccggaaagcggccagtgagctggcgaagaagaatattcgaaatttgcagcaaggaaagaattgatcgtataccgcccgtggggagaatggttccctgcgggcggcgctttttcttctgcaaattgcagattcgggcttgctttatttcgcttaaacgaatataattataatgactttttgtatgtgcgatttgcgaggtgtttgctatgtatgggtatattacagtccaagaagccgctgataaatggggcatcacgccacggcaagtacagattttgtgcaagtcaaatcgtgttgacggcgctacacgtatgagccgcatttggattattcctgaaaatgcgaaaaaaccgacaaatgacaaaaggaaggcaacatatggcgacgactaatctgaccgagttgcaaaatcttgtggatcgatttcgtactaacatcgacttttataaagatgcaaagaattcatataatgagcattcttgcagaattgaatatattgatcctctgttaaagctcttgggttgggatgttgcaaacgaaaaaggattggcaccccaatatcgagaagttattgcggagaattactccactcgaactgaccgccctgactataccattacgctcagaggtgtgcctaaattttttgtagaagcaaagaagcctgcggtagatattaccagagatgcagatccagctattcagaccagaaagtacggctggaacgcaaagcatcgtctggctgttctcacaaattttgaatatctggcaatctacgatacttgccatattgctcacgaagatgatggatgtgctgtagcaagataccggctataccattatactgagtatgtagaaaagattgatgagattgtagggttgattgcgagagacaccgtttactctggtgattttgatgcttatttggatgcaaacttccctgcaaccggaggacaaacccagcaggttgatacactgtttctttctcaaatcaacgaatggcgtgtggcgcttagcaatgaactgtatgctcagggtggccgttatgcgtcgttggaagtgttaaacgatgttgttcaggagtttattaaccaaatcgtattcctgagaatttgcgaagataggaatctgccgttgtatcacaagttaaaagatactattacagatgacaatcagttgcaagcaaaactggaggaattgttccgttctgctgaccggcgctacaattctggaatgttttccggcgaagatattattttcgatctttcctgtgaagttataaaaggcatgattgaggatctgtattaccctcaaagtccatatttgtttaatattatcgagcctaatttgcttggaaagatttatgagatattcttaaccgaacagttagtattgcttgaagacaataccattggtcttggtagaaagaaagattgccagaatagatctgttgttacgacaccgacggaaatcgttaagtatatggtcgataaatcactttctaaagtgtgtgaaggaaaaacgccctccgagattttgaatatcagtgttgctgatattgcctgtggctcgggcattttcttagaagaagcatttgcctatttgcaagattactgcgtgcaatggtatatcaataacggacaaacagatcatttaattgaggcgggcatcgatttgtacaaactgcccctgcaagagaaaaaagacatcctttgttcctgtatttacggcatagatattgacatccatgcagtcgaagtagccaagttttctttattaattaagctaattgaagatgaaacggcaccttctgtggcagaagttgttccgattcttcctgatttgggcggtaacattcaatttggaaactcccttgtcagccaaactgacttgaatggcattaacggtgccaaccgtcagatgatggagattgctccctttgactggagcacaattaacaatggacgtggatttgatgtaattatcggcaatcctccatatgtgaataccgaggggatgcacgccctattgccgagtgctgaagtagaggtctataaaaagaaatacaagacatcgtacaagcaattcgacaaatactttatttttatagagcaggctatcaagaagatcaacgaaaatggcttggtatgctatattgtacctaataaatttttcaaaattggcgctggcgagaagttgcgcaacctgattgcaaaagaacggatgctcgtcagtctggatgactttggagatgcgcagttatttgaggataaaaccatttatagctcgatcattttactttccaaggcgaagcagacgagttttgtttacagcagcgttgattctgctaacaaactgtgggcaggagaagaagtgagttccatcgagcttaattcttccgtattgaacaagctaccatggagattgacaactgactttgagtttttgacaatgctccagaggttggatgaagtatctgtccccattacaaaacacacagagatatttaacggcattcagacaagtgcagaaaggccaacgcctatatattggttctcctcagatgaaattgtggccgaatatgccgatactgttgaaatcagcagggatggcaataattatactattgagaaggccttgcttcgcccttattttaagccaaccaaaaaagctgagaagggcctgaattcgtatagtattcttgcgactgacaagcagattattttcccctacgacaacaacggacatcttatccgcatagaggagatgcaaagcagttatccgggaacatacgcttatctcttagctcattatgatcgtctggttcctaagtgtgtttcccgtgatggaactcgtgacgttccaaacgccacctcagatacatggtaccagtatggcagaacacaagccttgaccgcctttattaacacgcccaaattgatagttggcgttttgagcaaagaacccatgtatgcaatggatacgaatgatatgctgattgcgtcaggtggtactgctggatattgtgcagttagcaaaaaagatggtagtccatacgcacttgaatacatccaagcatggctatcaaaccccattacagagcgaatcttggagatcgtaggcagcgattttgaaggcggatttactgctcgtggtacattcgttctctctacactaccctttgttgagttggattttgccgtggaagaacaaaaagtcattcacgacagagtggtagcagcaagtcgagagatttacgaaatcaatgatgcactgtctggacgtcccgcaaagcgcattgcaaatctgttgcagaggcagaaagaaacacttatctctgagattcagggattgattgatcgggtatatagactcgattattaagcgaggtattaacgatgagactcaaaaaggatagttcagagcagaaactaagaggagcatattatacgccattgcagcttgcggatgctatagtggagctttttgcgtctcaaaatatctctactgtcttagaaccaagttgcggtgatggagtatttcttgatgcgctacagaatcttaatcttctgaataaggtggataaactaacagctgttgaaatcgaacctgacgaagccgagaaagttcgtgataggtattctgaatttgaacaaatcgaagtatgcaccgaagactttttcaacttctataatcgtgttctcggcaaggagcagtacgatttgattttgggcaatcccccttatattcgctatcaatatctaaaagaaagtcagcgagaaatgcaatctcaaattttgactttgcatgggatgaaagcgaataaattgataaatgcatgggttgcatttattgtagcatgcgtacagctattatccgaaaaaggtaagatagcatttgttattcctgctgaaatacttcaagttgcgtatgcagaggatttgcgcttatacttggctaacaaccttgctaaaatcactctgatcacgttcgaacgactcgtattccctgacattgagcaggaagtcgttgtatttattggcgagaaaggtgaagaagaaaaaggtatccgcattatagaaatggatgaccttagcggtttttcgagattgaatttggggcagaatggttttcagaagttacaacatgtcaaagaaaagtggacgaaatactttgtaaccacagcggagatgactcttatccagaaactccgtgcggataagcgatttgctaagttctctgaatatggcactattaatgttgggattactacagggaacaatagctatttctcgattacagaagaaacctctgaacaatatcatctggatgaagtgacccttcctctgattggaagaagttctcatgcacatggaatatactttaccagagaggactgggaaaacaaccgggctacaggaaagcgcgcaagactaattacttttccagaaattccatatgaagaataccctgtcgcacataaagagtatatttcgctcggcgaaaggagtaacgaacatacaggctacaaatgctccattagagataggtggtatattgttccttctgtatgggttccagatgcatttttcttgagacggaataacctataccctaagtttgttcttaatcgctgcggtgcagtttcgaccgatacaatgcaccggatgaagttcaatgctggtgttgatccagaggatatccttctggcatattataatagcatctcttttgcttttacagaaatatgtggtagaagctatggcggcggtgtccttgaaattcttcccggtgagatgggtaacattcttttgcccaaaatagaacatattgataccagcctacgaaatagtatccttgaaaaagttgatagaatcgttcgaaaggatgagaatattgaaaaagcacttgatcttgtcgaccaagaggttctggttaatctgctaaagattgaacctgatatttgtaagtgtttcagacggatttggaaaaagatgcagaagcggagattaggacgaggataaactacgaattctgattaaattaaaacgaagggaggaaaatctatggaatggagtggatgtatgagtttgctccaaggatatttggagaatagtccgttgatagttttaggatcaggtgcatccatgccatatgagcttccttcgatgggtgggctcgcagaagaaataaggaaatccaatattgtaatctccgatcctaattatagtgccttttgtgcggcagtagataattcagggctggagggagcaatagatgccgtgaatctccttccagaaacactacaggaaattcgtagagttgtttgggaaactgtcaacgaaaaggatcttctctattttaatcaacaccccatagacccgcccaaagcattggctgagctaatcagaaaggtacttgctcctacccccaataaagccgctattgtaactaccaattatgatagattgacggaatatgctgccgatggagttggtgcaactacagttactggatttgagggctctttgattaaaaaattagagcttccttcaatcccattaaaaacaaagcggacacgagctcgcgaaagaattgttgatatttggaaagtgcacggttcactggactggtttgtcgctcccgatggaacaattgtggcattcccactcactcaaacaatccctaatgattttcaaccgttgatcgttcctcctggtaaagaaaaatacagtagcacccatgatgagccgtatcgaaccattattgcggaggcagacaaggcgtttgtgcaagcaggtgcatatttatgtgtaggttatggatttaacgatgaacatatacagccaaagcttttagcacagatttctaaaggaaaacctattgttatccttgccagaaccatgactcaagcttgcaaaaagcatattgttgaggcaggaataaacaagtaccttatctttgagtgttcagattccacccatacaaaagtatatggtaatggatgggaggaaacatatgaggggcaatattggctcttggacaactttatgaatatctggtgaggagggatagcgtgagtatatttgaatatatgcccgaagagctacttggtactgttgaaagcgtagatacatctactgtgatagtaaaagttgaaaacgatgacaagctgcgtggattacaagtaaaccatctaatctccattcaaagttcaaaggttgggcaacacttaataggcttggtgtcaaaaataatacgaaaatcagcatatagtgatccggttgcaaatgtatcacctgagtttggctttaacattattaaagtgattctaataggaacgcactttgatagagatgcaggaaaagataacgtatttcgacgttctctggctacaataccaacaataaatgcggaatgtcatcttatacatggagatagattaaagcggttcatgcaagcaatatcttccattccagaaggtgaagatgcagttagcttgcaaattggtaattactctattgacgaagatgcaacggcctggctcaatggaaacaagctatttcagcgtcatgcagtaattgttggtagtacaggttcaggaaaatcatggtgtgtagccaaaatacttgagcaggtcgcttctctcaagtcagcagatgcgatactgtttgatattcacggcgaatactccactttgcaaggtgatagtttttcacatcttaaagtcgcaggacccaacgaaacaattggagagggaacgcttttcctcccttattggttgctcacttatgaggaaatgctatcgctcatgcttgatcggagtgacaacaatgctcctaaccaagccatgatgttcagcagtgccgttattgagggaaaaaagcaattcctgatagatgcagacaaagccgagatggaagcaaatattactttggatagccctattccttataatcttgatgcactgctttttttcctgaaatcaaaagatgaggaaatggtaccaggagctaaagcaaataccgaaaaacaaggtccatactttggaaaacttactcgttttattcagcgattggaaactaagcaaaaagataaacgattgaattttatgtttgcatcggaggatgatttgcttagttatgattacatgagtgtactttgtagcaagctaatgttaccttctgtggctggcaaaaaaggcgtaaagatcattgatttttccgaagtgccatcagatattcttccgttgatagtctctcttatagctcgtataattttttctgttcagcagtggacaacagttgaacatcgacatcccattgctattttctgtgatgaggcacatttgtacatccccgccaatacggaaaaaagcattgatgatgccagtttggtcacttttgaacgaatttcaaaagaaggcagaaaatatggcattggattggttgttatttcacaacgtccttccgaagtcaatcgcactgtcttaagccaaagtaataattttattgcgatgcgtctcactaacgttgacgatcagtctgttgtaaaacgccttttgccagacagtttgggggactatgcagagatgcttcctatattagatattggagaggcacttgttgttggtgatgcgagtttgttgccgagcagaattcgcatcacgcctcctactttgaaacctcgtagtgcaaccatcgatttctgggacgagtggtcaaaagatacaaccagcgtagatatttctggtgcaatagaagcattacgaaagcaggcaaagtagcaagtactggtttagactatgcagagaaaaggtatttgggcgctggtgtatttgcaagtaaaaagccagatgctatctggaaaaagaattcaaaaaatgttataatgcatccaagacacccgcacagccctatcaagaataaccactgatagcacaaggctgatagatttttgatagcagaatttcggatagaccataggataaggataatctgtatcaaaacaaataacactgaatcaaatcctctatacaaaaaagtttagagatggatttaactcggcgagtgggaatgaagagttttttacaatgattattttatatgtcaggcattattttagttggtttatttttaaaaacaggagcgatacagaacaaaaattctgtatcgctcctgttttatcatgatactctgcaaaatcagtgtgaattcatcggatattttcaatatataactccaaagtctccatatttcttggatatggcagcgatctatccagtattccttttttgcacaggcgttcaaaaagctccataacgattggcacatccaaatttgttttatttaaagccgaatgatttctgaaaacatctgtagggattccctgaaaaagtacacttccttcatgaaaaagcacaatttcatccgcccactcataggcataattgacatcatgtgttgacattacaacagtaatcccattatctgtcatttgatttacaatttggttgaccaaacgggtgtgttttgggtccaacgcagcagcaggctcatccagaaaaatcacttccggatgcatcaccaaaatatcagcaattgacacctgttttttctgtccaccgcttaaagcatgtgtcggcttgtgccggaacggtgtaatttccaagttggtgataactgtctccacctcttttttggcctgttcctccgatacccccaagtttaaaattccaaaagaaatttcctggtaaacactggcggaaaaaagctgattatctggatcttgaaatacgatcccgaccttactccttaattccagcagactctttttatcataggcaatctcttttccattaaaatacaaccgtcccctttgcggcttgcacactcctgcacaacacagaaaaaaagtggattttccactcccattcgctcccatgaaaataattttgcggccgcgtttcaattctagggaaaggccttttaaagcatatgaccttccctcgtcatatgaaaaatccaaattttcagcttttaaaataacatctgtattcatacagtcacctatcctatcatattgtgcagcacaaatagaaatatgctcctgactggcggtaatcagactttcgctgccaaggcagatgcaagcatagatgttcaacaggaagtatgcttatgtttcatttccaatgctaaaaggtgctccatacagcgaataccaacagagctgcatcatatgtgatgatagcggcgaccacatgccttttagggggctggctctcggataaaactcggattgtaccgtcataacatctggtttccattgcaatatacaattgactggaacggatcattgcacgcatcattaaaacagaacccagcataccaaaggatttgaccgatgttctataatccttatttcccaagcggcagctttgcgaaatcgaaatcgcggaagctgtatttaacagaataaaaataaaccgataaatcaaaagcattaattcgataatcagtttcggacaatgcagttttcgcatcacttccaaaatatctggaaccggcgtagtcaacgataaaaaatagaggcatgaaacggccgcaagagctgttagtatcagttgcagcgcatatacaaatgaagctcggctggttgtgatataccaatcgctcaaaggaagtgcaaataaatccattggtgtctgcttgatatggaaaataattgcaaccgtacttaaaaataaaaacgccagcgggatagtaagcagcctcatataacgcaagacagggaccccaccctttaaaacggtgagaatccctgtacttgccaacaccatacatgccactgtaatggaacggcttgctacgcaaatgcaaagcgtaataaccgcaaaagcaaatttttcaccggcgttttcatatctaagctttgaatgataacaaaactcatctatgatcatgattcaagaaatcctttcaccggtaaatgattgctctgcttttgtccattttttccgttccacgaaccggcccattacgaaagcgataatccctacaccgatccctgtctggatacagaagaataagctttcaacctctcccggaagctccccgccaatcaacgcctccagaatcggcgtcgcccacggctcataagcggagtccacttcctctacaacaacgcttccggcatcatcggatccgccaaattcggcgtcctttaatacaaacaatgggatcagtgcaatgaggaaaattacaagaattcctgcgattactttctttttcatattatttcgcctcctgtaagtatccaatcgcacgaagctccggcttcgcataggtttccagtccgacgacaatgagcactgtgataattccctcaataattgccagcggaacctgtgtcggcgcaaatacgagcaaaaactttccgaaagcggcgcctgttgtcgtatccgcatgatgagctaaagccatttggcctgctgtcacacagtatgtaaataaatcgcccaaggtggcggcaaggaagatcccggcctttttgtttacattcaacttcttgcaaagcgcatagattccaaaagaaacaaacgggccggcaattgccatggaaaatgtatttgccccgattgtagtcaggccgccgtgcgctaaaagaatcgcctgaaacaacagaacaatcagccccaaaacggaaacggcggccggcccaaacagaattgctcctagacctgttcctgtcatatgagagcagctgcctgtcacagatgggattttgagcgaagaaattacaaagacgaaagcgcccgacatcgccagaagcgtcacaagatttctattctcacgcaacgttttttgaatggacaagaaacctgcaatcagaaacgggatacacaaaacgccccatgaaatacaatacccggccggcaaatacccctccatgatatgcatcgcattgactgcgggagtgatcccaaatacgagcgcaaaggcgcttgtccatacgatcagcttcttttgttttagactcatctttttgtctccctttctattcttcaagcatataaaaagacctgccagatcactgacaggccaacaaaacaggatgactatggtaagtcaacctgtttttacacacggccatcgttcgtaacctgtgccaaccgcatatacaaggcaggtcttctgacttgggcttcatcactgcatttcgccttcccggctctgccagtggcgcaagcaaatgcaattcttcccttacagcggcgtgaccgtgtgagattttcactcagctttcctattctcctgcgttaagcaggcaccttgcatattgaattctaaaattagtatatcaattcgataggggtttgtcaatacagaatttaccattctctgtattgccgtaagccattcatcgggcgcagcctccaccatgacaacgcgcattatttttcttattcgaagggcaggcctcgattggttcatattgcgagagcagatcgcgcatctgacgcatagtcattttatgacagatttcaggtgtaatcgttttgtcatattgggacaagcgcgtgtacatctcatattttcccagggaaagcccgcacgcatgcgcggccggaacgtccttcaaatccgttctcctgcatgttcctccatactgcgttgtcacaacgctgttttccaactccaaaagcagttcatctgcgcgcggtgacgcaaccgcgactatcagcgccgcgtcatgatccaggtaagtttgcagcctgtcgctttccaccaaccgctccactgcctccaaataatttttcccggttaaatcaaggtccgccaaaagccgctgtccatctgcattttttccttctgccgctgtaacacgattgagccggttcaaagtcaactcgacagaaggattgatatctacactgatataggaaaccggcgcggcaaacacataccagtttccaatccccatacaaagaaacagcccgcacgcaacagccagacgcaagaccgctttggaacggcgttttttcttttgattgtaccgtgcaatacacgcggcggcagattgcctcatttgatctgtcgcgtggatttgtgcaaacgcccgaccaatctgattattcaatcacgtcacctcccagctcctgtctgagcaattccctccctcttgacaaaagggagtatacggtgttctcttttttcttcaggatccttccaatctcacgggcattgtacccttcataataatgcagataaattacgtccttatatttttccggcaacgccagcaccgcttccagtgtcgcatgctgttcagacgaaatacttgccgcttcctcggacagtacctccagcgataccgttttacggcggaacaggctttttaaaagatctttacaggcgttcaccgtcactctaatcaaccaagctctttcgtgctccacactttcaaatacagcgccacgaaggacgtatttcagaaaaacctcctgaaatacgtcctcggtatccgcatgatttttcaaatgcaggagacaaatcctgcgaatcatgtctgaatataattctattgcacggcttgtctcctgctctgtgcacatatggcctcctgctgtttatcgaccttctgtcagttgaacctgcctctccgtccgcatccgcctccaatggccgccctgccgccgcatccggagcctttcccggcatagtcgcagacgccgttcccatctttatccacgaagcggccgtatccacaatattcaccggcatagtcgcagacgccgtctccattttcatccacgaagcggccgcgccaattatcagcggtatcctgcgcagcaaccggcatcgtcagcaccagcatcataaggcatacagcccctgtcatcaatacttttttcattgtcaaatacctcctagtcttttggggatttcacttactatacgactcagcaaagccaatccttgcattggatgggaaaatttttatccggtattttctttataatagcacactgttttttcaattcaagataagctgcataaacttcccccacttcgagcgccagtgcaaatgtccgctatgcagccaatatctgacgtgttataataaccgcaaagcggttattataacaggattatgcccaacggctcgccgcttgcgcggcaaccgccttttgatgggcaattataccatgtccgcgaagcggcatggtataataatcataaaatgatttgggggcggctgcaatcagttcctttgaaaattggtttgatcgtgaaagcgggtattcgccgcatatgatcacaaggcgcatgctgcttgaagcatgtgcctgcggcggcatgcctgtccaggatgggcgtaccgccatagtcgccggtgtttcaggacaggcgcggctgcctgtctgtacgtgccccgcctgccacaagctatacgcgcagattggcagcggatttttaccactggataatcctttgaaatttcgtatcgccctgccctgacaggatatatctggaatccacaaaatagttgttaaaaattcgtttaatcagctcatttacaaaatatatccttttcagtataatgatgtaaaaagggaggttattataatgaaagggtttttattcaaattgatggcgctcatggcaatcatttctttaattgtgatgcctgtttatgctgatcattctgccgacaatgacgttttaggagctgatgatgaggatgaaagcgccttttccgattcttattcaatggatgttcgtgaagtaaacattgatactggcgaagtgagcgaattttctatcgatgtacctgaacctcagatacagccgctttccgatgaagaatcaccttgggaacaaattgtccgcctggctggcgcagaaggaaagcatcctatggaatatctggctgatttgcaggccgatatgccaacccccgcctatgattttactggtacaaaaacacaagtcaaagatactaccatatccccctatgatgggatcgtgtatttgggattaacctacagtagcagcaattttgaatataccgggacaggcgtatggattgccagcaataaaatattgacttgcgcccataatctggaacctatcggtggaggaaagtccatttccaaattgaaagtcattacgggcagaaatggggctgcttctacttgcgtgagcacaggttcaggttccatgacctatcgtgttcctgcttcatggggtaaaaacggcagttttcccgccggagacgattattgtattataacggtcgaaaagccaggaaaacacggcacgttttctttaaattcttccctgtcttcttcaaagacttatacgctttgcggatatgaatatatatccgggaacaaccgctatcagactaaagacagcggctctgtttcagtaaagagcggaagcaactcaaagcaattaacatacaaaatttatggcggtccggggcagagcggcgcacccatttataacggtacttccgtcgttggaattcatgcatatgagattcaaaattccagcggtgaatatacaagcaacagcggtacaaaaataactccaactgttatcagctttgcaaaataatgctttatataataaaaaatccaagttggagcggaagaactttatttcgctccagcccgtggtggtgaacttatgaaaggcaggttgatttgtatattatctgccgccgccatattgtacggctgtggattttccggagcctatggcggcaatatacccgcaggtatgtcatccactggacaaataatgctgtccagcgatccgtccgattccgttgccattcattcatcatctgtatcttccacagcagagcaatcctccgctgcaaaattttattcttctgcgggggagttgtccatacccgtttcctccggcggctctgccatagcggcggcgtcttcggccatttccaatggtgaaaaggaaaaataccccattacatttcaaatccgcgacccaaagggccggccgctcatcaacgcaaacgtcagcctgtcgcaatatacggaccatgggctggaaagcgtatttcagagtgatttttccaaaacaaaatctgatggaatatttatactcccggggctgttcgaaagcggggcctatcaggcgcgcgtcaccctgcggtcagattatgggcaagcgattgctgaagagtttgatatccttctgccgggagatgacatgggagttttcaacctgtctttaaaaagcaggattgaaagccctcccgaggaggaacgtccgacgcatgtaaatctggttgtgaaggacgaagcgggtaatccgatccctgatctgtggctgtttgtcaccgacgagcctgttattctggaaggaggagctatcccctctattggaggccctgcttataactactggggatttacagatcaaaacggcacccttatccggtggaacgcagatgtgtggaataccaataccattccacttaaatccacatgcgaagtatataaaggggtagaacctgttgatatttcatccatgaaaaagtttaaaatgggtaaattcggatatgaaatccctgatttagggacgaaaatcggagaattttattatgaagttcccgattttgaccattcttatgaatacacattcgttctaaccggttatacaatcgattgaaaaaattttttcgcaggctttatggcgcgccttttggctggaagggcgcgcttcttttttgtctgtgcaaaaagccgtcaaaactgtgctgcatggggtgagccgtgccagtcgccacttttgccgcggtgcatagtatacaagtgtgagcaacactcagcggcggcagtataagggtggcgacagcctgcaaaacagcctgcgtatgacgacctgctgctttatatagacccctccgccggagggcagccgctctccggcggaaaagtcctccaatccggccggactcttacgtacatcggccgctgcctgttttcaggcatcctgctgcttcacataaacctcttaaatgaaaaaagtccgggacgggcgcgcatgcgcgcccgtcccggacttttttctcctaattttcaggtatggggcatcttatctgtaacagacatctgtattcattccagccgctccggcttttaatctctaaagcaattgctgtctcaaaataccgagaatcttcttttcccgacgcgatacctgcacctgggtcatcccaaggcgggccgctgtctgtacctgtgtcatcccggaataataacgcagctcgatcagggcgcgatccttatcttccagcttttcaaccacctgattcagagagatcacatcggcaagctgatcctctggtgaatcagccggcaaatcgatctgtccgccgccgtcctcgtcgctttctgtgagagacaacggcggcgcagcggcgcaaagcgcctcgacaacctgctcctccggcagctccatcgcctgcgccagctcgctgacactcggctcgcgtccaagcgcaagcgcgagctgctcacgcgcgcgtccgatccgcagcgacagctccttgagtgtgcgggacaccttgaccgcgccgccgtcgcgaaacagccgccgcatttcaccaagaatcaccggcacggcataggtcgacagcttgacgccgcgctgtggatcaaacgcatcgactgctttgcaaagccccatgcagcccgcctggaacaaatcgtcatattctattccgcgccctttaaagcggtgtgcgcaggaatgtacaagcccgatattttccgatattgtctgttcacgtctggtatcgacacattcgatcacagggttcatgcctccttgctgcgaatgtctctttccagagtcaccgtcgtcccctttccctcctttgatgtcactttaacccggtccatcaggctttgcatcaccgcgaaaccaagtcccgcgcgttcctcctcgggagcggttgtatacatcggctccattgcctttttcacatcgggaatgccgcagcccttgtcgcggattttaatggaaacatggctgtccggaaaaatattcgctgttatgtatacgatcccgagcgtgtcccggtaagcatggacgatacagtttgtcaccgcctcactgacggctgtcttgatgtcagaaagctcctcgatcgtcggatcaagctgtgcgataaatgctgccaccgctgtacgggaaaaagcctcgttgaccgatctcccctcaaactgaagcttcatagagttacatgctttcatcttcgtcccctccggtcttttcaatatgtccggctgtcacacgccgttcgggcttatccatcaccgcaagccggtccagtcctgcgagcatcatcacctttttcagatgaccggcaatgttaacaacccgaagcgagccgcccacctcctgcatcagcttaaagcggcccataacaagtcctattccggaggaatccataaacgttacatcacgaaaatcaagctccagcgcgcgcgcctgcgctttaagcaccgcgtcgtcaatcgtctcgcgcatttcccgcgcattgtggtggtcaatatcgccaatgatatgcgccgtcaccagctcgtccgtcagatcgatttgaacagacatcgttttcatacgtcctttcatcacgcgccgggcacggcgcgcgtggttcggcaaaagtccgggccgtgcgcgccgccagacacagcccgcacgccgtcaaaaaagccctatccataggatagagctttttgggtaaaaaggatgtcgaagcatgacatgcaaacatatttcatccaacatccgcaaacctggcgcgtacctgggaggcgaacagcagcgacccgcagacaacaattgcgccgccctgtgccgacgcgactgcctgcgcaagctccaacgcctcgtcaatactgtgtgccgccgaagcgcgcagccccaccgcgtcagcgcgcacagccagctcatgcgcaccgagcgcgcgcgggctttccggtgtaacgcacagcacgcgcgccaaacgcggcgcgagcgccctgagcaggccggtgctgtctttatcagccagcacgccgatcacgccggtcacgggctgatccccaagcagcgtcaacgcatccgcgagcgcgcccgcggcctggggattatgggcgccgtcgatgattacaagcggattgcgctgtacaatttcaaagcgcgccggcacatgtaccccggcaagcgcctttgcgatggtccgctcgtccggcaggcgtccgaggagcgcagggagcgcctgcccggccgctgtaatcgccgtaactgcgtttgtaatctggtgattgcctataagcggcagatgcaggcgcatcccctgatatataaagtctgtgccgtccagtccggactgtacctctctgacagcgcccggatttccggaaatcagtgtgcagccgcgctttgcacactcctccataatcacagccagcgcgtcagggtcctgtttaccgcaggtcacgacgggaacgcccggtttaatgataccgcatttttcaaaggcaatctcaccaagcgtactgccgagcacgtccgtgtggtccagcccgatgcgtgtaatcacagagacaagcggccggctgatcacattggtggcgtcgaaccggccgccgagtccgacttccgccacaaccgcgctgcagccgctatccgcgaaatacgaataggccgccgcagtgatcagctcaaactccgtcatgcctcccacctgctcggcgagcggcgcgatgcgcgtcatttcgcgcgcgagcgcctcgtgtgcgatcggcgcaccgtcaatctggatacgctcgcaaaaatcggtgataaacggcgagacggtcagtcctgtacgcaggcccgccgcactcaggatagccgccgtcatcaccgcagtggagcctttgccgtttgtccccgcgatatgcacaatgcgcaggcgttcctgcggatcgccgagcagcgccatcaggcggcgcatccggtccagcgtcggcgggccgttaaaacgtttacgcgcatgaatataggaaacagcttcctgataggtcacaaatcatccctcctgtaagaacctgtattcacagccgcaaaacgccgtccaggcgggccttttgcccccgctccacgttaaattttcttgccgggcgacagcccgcctgcaaaaatttgccttgatcgggtacaaaatccctcgcctgtccagtatcctccggctgtaaatacaggttctaaaactgcaaaaaggcgctctcccaacacgcccaaggctgaaaagccgggacggaatccccgccccggctccgaaactgaccagtaagaccaatcctgtttttcgcagggcttcgccgtccacagtccctccatttaagaaaatgcggcgatactctcctcgatctttgcaagccgctcacgcgcttttgcaagcttggcacgctcgccgtcaaccacctgcgccggcgccttggcgacaaagccggggttgtccagcttggacgacagcgccgcgatgtccttttcacaggcggctttctcacgtccaaggcgcgcaagctccttctcccgatccacaagctcgtccatagggataaagacgcgcgcggcgtcggtcacgacctgaacggaaccgtctgcgtcatagctgtcgccaagctccacatcggaagcgaacgcaaggcgcgcaaaaaatgggcgtccctgctcaaatacagccttatgcgccgtcatgataaacagacgcgtctttttcgacggcggcacgttcatctctccacggcgggcgcggatggcgcggatcacctgcataatcatctcgaagtcggattcgtcggcggagaaatcgagcgcggcatcggcctgcggccacggcgcgaccatgatgctttccccgtcgtgcggcagcgcctgccagatttcctcggtgataaacggcataaacggatgcagaagcttaagcgtgccagtcatgacgtacaccagcacgcgctgcgccgcctcggacgtctcgccgcccgcctgcaggcgtgatttacacagctcgatataccagtcgcacagaatatcccaaataaaatcgtacagcttctgaacggccaaaccaagttcgaatttttcaagattgtccgtaacctcgcgcacaagcgttctgtatttcgaaaggacccacttatcctcgatattgagtgtctccggcagccccggctctacatcgtccgacaggttcatcaggataaagcgcgacgcattccagatcttatttgcaaagttacgtgacgcgttcactttttcatccgagaaacgcatatcgttgcccggcgaattgcccgtcgccagtgtgaagcgcaacgcgtccgcgccgtagcggtcgatgatctccagcggatcgatcccgttgcccaaactctttgacatcttgcgtccctgcgcgtcgcgtacaagcccatggatcagcaccgttttaaacggcacctcgtccatatgcgccaggcccgaaaagatcatgcgcgccacccagaagaagatgatgtcgtatccggtgacaagcgtgtccgttggatagaaataacgcagctccggcgtattgtccggccatccgagcgtggagaaaggccacagcgcggacgagaaccatgtgtcgagcgtgtcggggtcctgctcaagccgatgcgagccgcatttcgggcaggtttgcggcgtttcgcggcttacgatcatttcaccgcagccggtgcaataccatgcggggatgcggtggccccaccaaagctgacgggaaatgcaccagtctttgatgttttccatccagttgaaataaatcttatcaaaccgctccggaataaagcgcgtccggccgctgcgcacggcctcgaccgccggcttggcgagcggctccatcttaacgaaccactgcttggagacgcgcggctcaatgacgctgccgcagcggtaacaggacccaacattgtgcttatatggctccacagctttgagaaaaccgccgtcctccagatcctttacaatctgccggcggcattcttcgcgcgtcaaacccttgtatttcccgccgttttcgttgatggtcgcatcgtcgttcataacgttcacgatgggcaggccgtggcgcaggccgacttcgaagtcattcgggtcgtgtgcaggcgtaatcttcacaacgcccgttccaaaatccatctcgacatattcgtcggcgacaatgggaatttgtttgttgacaatcggcagaagcaccatttttccaatcagatgcttataccgctcgtcgtccggatgcaccgcgacagccgtatcgccaagcagcgtttccggccgtgtcgttgcgatttcaagcacatcgtccgtgccgacgatcggataattgatgtgccagaaaaagccgtccttctcctcatactccacttcaatatccgagattgtggagaggcaatgcgggcaccagttgacaatgcgctcgccgcggtaaatcagcccctgctcaaagaaacgcacgaatacctcgcgcacggcgcggctgcacccctcgtcaagcgtgaaccgctcgcgctgccaatcgcaggaggaaccaagctttttaagctgatcgaggatatggccgccgtattcccttttccatgcccaggcgcgctctaaaaagccctcgcggccgagctgttccttggtcacgccttcctggcgcatcgcttcaacaatctttgcctccgtcgcaatcgacgcatggtcggttcccggcagccagagcgcctcataaccctgcattctgcgccaccggatcaggatatcctgaagcgtctcgtcaagggcatgccccatatgcagccgtccggtgatattcggcggcggaatcacaattgtatacggctttttgtccgggttcggctcggcgtgaaaatatccgccatcctgccagaaccggtacgttttgtcctcgacctgcttggggtcgtagaccttgtccagctgtttcggcatatcttttcctccagtgtccatttatacacagtcttgattcataaacaatattctatattatagtggatttttccccgaaatacaactgtcagcgccagccggcataaaaaaatacggaaagctgaatataaaaagcaagcctgcgctgggcgcaggcttgctttttatattcagctttcagaccaaccggcgcaaactgcatgagtggaacgcctgtcccactgttcgcggcgcagccgactaaagttttttgccaagcttttttaaaaaagcgggcggcctattgatccaggtaaacgagcgggtcgatcatgcggccgtctacacgaatctcgaagtgcaggtggttgccggtggaattgccggtggaaccgacatttgcgattttctcgccctgtttcacagtctggccaaccgatacggatactgagctgttatgtccgtacagcgtgcgcgaaccgtccgcatggcgtaagatcacacaaataccgtactcgccgtaccagcccgcctgttcgacaacgccctcggccgccgcgtaaacaggcgtaccatacggcgctgccaaatcaatgccattgtgatgcgggtaatcataaaaatccgccgacagccatccacccttgagcggacgtgcaaacgatgttttccaggcgctgccgtcggcagtctcgctgtagaggactttcgtcccgcgcttcacgaccgcatttacaggctgcgccgtctgctccgctttgattgaaaccaccttgacggcacgatcgccctcataaatcacctgggcttcaatcttctgctcccctggcgtgccgctgcgcactggctcctcataaccccggtaaatacccggcaggtctatgtaggaggttgcaaatggaattttctgtgtcgttgtaacggtgcgcgtcacacgcgccggcacttcgagcgcctgtgtgtgcgttgcaaacaaaaaaacacacactacggcagtgatggccgccgtctgttttttcattctgttataccatctttttgtcccattccctgctgtcttaacaatcgattcgaccgcaggtttctccataaatcatcctccttgcgggaaatttgcatcctgccgtaagcagcacaccacacgcttacagcaagtacttttgatgatagcggtcaattatgaataaactattaatatttaaatttattcatataagctttacgatattggaaacgcttagattatcggattggccgtttactggctatgttggaaaagcaagccgtcacagattttgacacgaacgcttgaatttaggggaacattgcagtatgatgataccatagttttgactgtggagggtaacacattgtctcaaatattagaagatatcagcctttgtttacaacagggccgcgcgcctgctgtcaaagaacatatttcgcgggccattcaggagggactgacagccgacgaaattctcgaaggcggtcttttggcaggcatgggagtaatcggcgaaaaattcaaagccaataaagtctttattcctgaagtcatgattgccgcgcgcgctatgaacgccggacttgaattgttaaaaccgctgttggctgccgccggcggccaacagcgcggcactgtcgtgcttggaacagtcaagggtgaccgacatgatattggaaaaaatttggtaaaaatgatgctcgaaggcaaggggctgaaggttgtcgatcttggcgtagatgtccccgcagcccgttatcttgcagctgcggatgagcatcaggccgatatcatcgcctgttcggccttgctgaccaccaccatgaatgaaatgcgaaatgtggtcagccttgttaatgaatctccgcttaagggcaatgtacgcgtcatgatcggcggcgcgccggttacgcagagcttttgcgatgaaatcggggcggacagctatacgcctgacgcagccacttgtgcggaagttgcgcttgggttctgccaaaagtagtttgcaagcgcacatcgtatgattttattataaatgaaaagacaccgctgtttccagcggtgtctttttcaataattattgtaatttttttccttcaaataaaacgcgttttttcaaatcctccatcagtgccgaaaactgcggcaaatcgagagattgcgcgccatcacacagcgcgtttgccgggtcgttgtgcacctcgaccattaaaccgtccgcaccagccgcaacaacagtacgcgccagcggcggcaccagccatgcgtgtcctgtcgcgtggctcggatcgacaatcacaggcagatgagtcaaccgcttgagcagcgggatcgcggagatatcaagcgtgttgcgcgtcattgtttcaaatgtccgcacgccgcgctcacataaaattaccttttgattaccgccggacaaaatatattcggctgacatcagccattcctccaccgtatttgcaagaccgcgcttaagcaggatcggcttattgcaatggcccagctcacgcagcagatcaaaattctgcatattgcgcgcacccacttgaataacgtcgacttcggaaaacagatcgaggcaatctgcattcatgatttctgtgacgattggcagtccggtttcatgtttggcctctaaaagcaggcgtattccatcggcatgcagcccctgaaacgcatacggcgaggtgcgcggtttaaaggccccgccgcgcagaagcgtggcgccgctcgctttgaccgactgcgcgacacggatgatctgttcctcgctctccaccgaacatggcccggcgatcacctgaaacagtccctccccaatggtcacatccccggctgtgacatgagtatcctgcggatgtatttttcgattgactgccttataaggctcactgatgcgtttggcgctttcaactatgtcaattgtggcaatataatccgcgtcaaggcgggaggtatcgccgatcaaaccaatgatcgtatgctgtgtaccttcgctgacattggttgcaaaccccttggcatggaatgaatcgagcaattcctgcaccttttgcggtgcgggattcggttttaatacaagaatcatttgaatccctctttttcaatttaaaacttttaactattaaagtatagcgcgtcgtaccggctttgtcaagcagagcgccggcgccatacaatataggagaaacgatttgggagggatcttagtgtccaacagtgtgcaagctgcatctgcgcgcaatttcaattccatctttcttgggcttggacttttgctcgtgatctgtgttcttatcctgccgttgcttgcaggaacgcgaaacgcatttcgataaacaaatccggctgggagaaaagcatcgctttcccctcagccggatatctccgtttttctttcagccgactgcccagaaataagaccgtctattcatcgcctaacagctattttcctgcgtgtttgcccacttgcgggcaggcgcattttgaacaaacggccccgcgctgcggacggcgcagagccgtttgtttatcggcgcgacggcagataaagtccggtcgcatctgttttcgcggctgtctccttcggttccgccgtcgccgagggctttgaaacagatgacaaatcgacctctttttccgctagaatataagtgcctggcgtgcgggtacgtacagtaaagatcgtatccccggaatcattctcgcccactgtgaaataagaggaaacatcctcaagcgttccattcgagatgcggtaaaataccacgtcctttgggttgatagccgcgtcaccgtcggcgtcaaacggattatagatcacaatggttggcaccgttgtagatggtatggaggggttgatctcaaacgcatacaaaaacgcgttctgatcatcaaacagatcggcgaatgcgcaatcgtcccagtcggttgacaggcccgcataaaaattgtcaggatcggaatcagccatatattgcagcttggcctgcgtttcagacccgctttcaaatgtgacgacgttcatctcattggcggtcgatttgacaacacctccgctcgcaaatgccgcagtacttagggaaagcgccgccaaaagcgccgtggctgtgcaaagaagctttttcatatctggaagtgatcctcctgttcattgttaaaatattccgctgtgttcagtataacgggatattgtgaacaaaacatgaaatataaaactttttcataaaaaacaagcggccgggtttaaatatgtgtacgcgcaacctctccatgttctgcataggatagggcgggaggcgatgccatggcgatgaatcagaatgggcggccacagggtggaatgcagcgcccaagcggcaaccgtccaatgatgcaggggcgttccatgcagggaagacgccctgtacagggacgtcctatggggaacggatctatgcagcgtacaaataatacatcgcgtcagccgggcgtactcggcagactgatcaacacaagcgaccccatcggttctatcagcaaaattgtcaatatcttaaagatcctgggctaacaaattgagcgggaacgatatagcttgagctaaaccgttcccgcttttcgcgcgtcatacagaaaagccgccgttgtctgctgtggaacgggaacaatttccggatagttcgcaaatagccagagcattcaaagaaaaatacgcaggaagcatttcggatttctaagttttttaatgcggtttttactgccgtttgctgaaaaagacggtggtttcacactcgtgtcgaggcactccaagccccaggcattgcatccgatgtgcaagcgtgttaaaataagtgacgaaaaggatacggatcgtttccgtacgatcattcaaggtgaggtttcggcatgatctttaagcggtatggtttgatcgcgcaccgcggcctgcatgaccgtgcgcgtggagtccctgaaaattcgctccccgctttcgaatgcgctgtcgcgggtggatatgcgattgaattggatattcatctgacaaaggatggacaggcggttgtctttcatgacgacacacttatgcggatgaccggcaaaagcggcaacattaaagaccgcacatacgccgagctgcaaacactggcgctagatggaacaaactgccgcattcccttgtttcaggatgtcctgacttatgtgggcggacgcgtcccactgctgatcgaactgaaaaacaagggatttccaggcgctttggaacagacgttcattcggcttatacgcggctatcgaggtccgtatatcgtggagtcattcaacccgcttacgatctggtggctgcgccggcatgcgccccagattatccgcggacagcttgcctgcatggaatatgacgggatgcgcccggggcttcgcacctttattttgagccggatgctgtttaactgtattgcacggccgcattttatttcgtaccgcctgagcgatattacagagcgcctctctaaaaaatgcaggcgccaacgtattccgcttttatgctggactgtgcgtaaaaaggatgaatttgataaagcccgccgtctatgcgacggcgctattttcgagcagatccgtccaaccctccgatctttttaaaagctgtatcaattgggagaagtacatggattgacggaaaaacttcttgtctgacaaggaaggaaagcgcagaaatcctgacggatttcaagcttttctgacgcagttcagacggggaattttccgccaaggcgtatgcgtcccccattggtacggcttcttgaaagtacagcctgaatcagcagcaaaaaaagtaccctccacgccggcatgtgccggcgcagggggtacttttattcagttgcgcatatcaagcacaaccgcgccatagccgaccggacgtgtcaaaaaaacgccctccgccagcccataaagtttacgcaggcagtgtttcgcctgcccgcgcgatgtaaaaaggccaaaaactgccgatccgcttcccgtcatcatagctcctaatgcgccgcaggccaacatgactgcgcggatttcttcaattgcaggcagcccggcaacctcgctgagtacattatacatcccttttgccagcccttgcagatctgcctgctctaagcaatgcacaagacgatccgtatcagggcggcggcgcgcgccgctgcggtcatacctgcgatagctttcagccgttgaaataccggctgctggcttcgcaatcaaaatatggcatggcggaagcgcaggcaatatggagaattcttccccaacaccgcgtgcacggcgcgttccgcccataatacaaaacggtacatccgcgccgactgtcaagccaagtccacaaagcgtctccacatctgcgccaacgtccaacaggccgtttaatcccaccagtacgccggcagcgtccgcacttcctccggcaagtcccgcttctgacggaattcgtttttggatatcgatggaaatcgctgtatccggccggccgaaccgctcaaaaaaacggctggctgcaatatgcgcataatttgtttcatcacaggggatgcgcggctgattgcatgatatgtagaggccctgcccactcatacgagaaattgtaaccgtatcgcacaggccaaccgactgcatcacggtatcaatattgtgatacccattttcgcgtatgcctgtgatatccaatgaaaggttaatttttgcaggtgcatcgaccacaatcgatttcatccgcaagcccccatttcctatgactgtatgtccagtgtaccacagcggcaagccctttcgcgcttgcctggcgcaaagcggcagccaaaccggcaaagtcggtttcggctgcaagcggcaaaaccgtttgccttgtacatattgtaccacaggctggtccaattggaaagacttatcttgatttggaaaacaaatgaaacagctttactgtatgcacatcaattgcacgcaccggacacatctcctgacagcaaaagcaatggatgcaattggacaggttgatttttgcttttttgtttttgatctggatcgtctttgccggacaactttccgcgcagcggccacagcccacgcaatcgcgcggtcgcacatgcggacgaggcgcaagctttggttgaatccggcgaaccaaaacagcgagcggcgccggaatattatttgtgaagtcgagccgtttagaatcaggcggcaaaaaatcatcgaagggcggcggcagagtgtcgcccaggacaaccgcctgcgaccaatcacacgggcataagccgcgtccgattgcatcggcgactgtgggcacataacgcggcgtcaggccgatcagatgcgccattacaagatcaagcgcatacagcccgtcgaaccgcgctgccgcagtaaagcccagcggccgcgcgcggccgccggttggaccgtttccctccattgccatcaccgcatccacaatcgtcaaagccggccgcaccaacagcgacaggtcgatcagcatccgcgcaaatgcatccgtatccggaaagcggtaatgaagctggggcttgagcagccccggaatacatccaaacagattttttactccgcaggaaagcatggtcatgcaatgagtcttcaatttacacagattgatcacgcagtctgcgtccgccaccgggtcaatgatatcaaatgtacggcaaagagctgcatccgctccgcgcagttcccgtgaaccgaccgtagtgttcagcttgacgccgtattgttttgccacggtttccatacccgtcgccgcataggccgccgccaaaagctgcggcgtatacagtcctcccgggctatcggcgatggtgatatcgcgcacgcccatcgcctgaagctggcgtacaaccgcttcaacaatcgcaggatgtgttgtggcggcacgctccgggccgcagcgcataatcaaatttggtttgattaccacgcgcgcatccggcgcgatctgaatatttaacagttcaaaatggcgctgtatcgcactttgcagatccgtttcgttgtaactgtctgtgtggagaaatgaaagctcagacatggtacgtctcctttgggcagggcggcgcggccccgcgcgctttgcgcgcgggaagcgcgaaggctccgcccggtcattatggcgcttggccaaacccgctgcgttgatgtttgtatcaacggcaaataatagtatcccgtcaaggcggggccttcgcgccggcgctgtccctttgggacagcgcgccgcgccgcctccccatctccgataaacgtatcagatcaccgtcgcactgtcgacgcctgaacgtgcgatcgcaaccggtacatcgccgcaggccgagcgtgcgaggccggcaaggtacggcacgacaaggttttccgtaccgaaatggcccgcatcgatcagcgtaataccacggtgcacagcgtcaagcataacgtcatgcttgacatcacctgttacaagcgcctgacaacccttttctaccgccgcatcaagcagactgccgcccgaacctccgcaaactgcgacgcgttcaaccacccggccgccgtcacaataacgcactgccgatagatccagcatccgtttgacataataagcgaattccggcggagccatcccgcgttccaacatgccggcgcgtcccatcccatcgggagcacgcgtcagctccaacacctcgatttcgttcagtgcgagcttttgtgcaagcagatcattgacaccgcctttggcaatatcaagatttgtatgtgcgctgattacagagattcctgcacgaaccaatttccacacgagcgtatcggatgtgattcgtttcatcgcatgaaaaatcaccggatgatgtgtcacaatcagattcgcgccacgcgatatggcctcgccgatcacactgtccgtcacatcaagcgccgccagcacgccgcgcacctgttcatttggatcgccgaccagtaagccgggattatcaaaatccagcgccagcgtaaaatctgccgccgcgtcaatcgcatcgtaaaccatttgaacggttgccatttatcttcctccctgttccaagcgcttcatcagcgcctcgtatcgctccaggcgcatatgtgaggcagcggctttttttaatccctcatactgctcccgcacaagccgcgccgccttggcgatataccggcgcgctgccgggctgtgatcatcaagcagcagaccgcacaatgcgaacgcatcatccacctcgcacggcggcgcgccggtataagccgcctgcataacggtgtatggaaaatcacccgatacaacggcggtttcccttaaaagcgcaaaaccattttgatacaggctgcgccgcagtcggtctgcctttgtcatcggctgtaaaataaagcgcagcttgtgatcgcgtgtccaaggctgcgcattgatcactccccatatggtttcaccgcccataccggcaattacaatatcctcaacctcgcccgcctgaagtcccatgagcccatcgcagcagattaagccaacccgatcgcgcactccatattcagacaatgtaaaagccgcctttgcaagcggctttttatggatatcgcatgcatatccgccgggaatctgcccgctggctgcaagccaggcgatcagatagccgtggtcgcagccgatatcagcacagcgcgcaccgcggcgcacaagcgccgcggccgctgccagccgtgcgtccaacttcggcagactgcgcatcagagggccgtcccgttgagctgctccagcaggcgcgcacagtccgcaccatgtacctcacaggcttgctcgattgtctcgccgcgcgaggatgggcagcccaggcaatgcatccccatctccaaaaaatagcgcgccagggattcgtcattgtcaagtacttcgccaaccagagaatcctttgtatacttcattatttttcctccgttctatttcattccaggagtctgcgtcaaactccgcctgcacaaaaaatttatggccgtgtatacaggttgagccgatggtcctctaaaaatgcgctgcaggatggatttccttccgcacggcgaacaacgccttccgtcagatcatacagggaagaccaaactgtatccgcacccatggcgctgtcatattggcagagaaatccgatccttccggacaacagcgactcggcaaattcgggggtatatggcgcgccagtttggaaagcgtttcgaagcgtttcataccggcgtttggaaaaccaatcgtccgcatcagccggctgataaatctgcatatctggactgttaaagtggtttgtcgtaaacacaaacggtttgttgggatgcggccgaatcactgaaatgcgctcacaattgcattccaccgcggccagttcgccgctttgatcggcaaggatcaacacctgtgccgaagcgattggcagccggcacagcatcgcgagcgcctcgcgggtgctggcgcacgtctcaagcaggcagcgcacgagcattcccgctccaaagcccggtttttggcggattgggcatataaaggtcataccgacagccaatccgcattcgttgacaccatcctcaatttctgtccaggccgtcgtgttgccgataaaagcatatgcgtgttccagtgtgtaaaaggcgctgtcacaaaatggcgcgatgccggcaaagaaatcgctgtttctgccaagcattgtttttccatccgcacaaaatgcaaagcaggaacagtgaatttgtggcgcaaaactgtacatcgaaagcaaaaacgttgcgaccgtgtcacgatccaagcccgctccatccgccattccccaaatctcgtcgagaacggccggataaaacgtctcatacagcgggatgctggcgcgtgtaaacgccagccgcgcttttgactgccgaaaatgaacgaatggatcgattccctgctcccgcagagcctgtccataagacagtcctgcttcataatgcgtaccgctccatctggaatgaatcataaaacgctctcctttgtcaaaatgagagctgatatcaactcatgcatagagcgtacccgattaaaaattttatgtcaatgaacaaactgtgaacaattgcagcgtcagcccttttctgcaaaaaagccgccgtttgtttaaacggcggctttgaaaggctgaaccagaaaaaattactggttttccttcatcttggcaaagcactcggaacaatagaccggacggtcttcacgcggctggaacggaaccttggcttcgcagccgcagttggcgcagacagcggtgaacatttccctctggggcctggcgttgttcttacgggcatcgcggcaggctttgcagcgctgcggctcattgacaaagccgcgctcggcgtagaactcctgctcgccagcggtgaaaacaaactcggatccgcactctttgcatgttaatgttttgtctgtgtacattttggttacctcgcttaaatttttggatttacccgctggactgagtggaccgagattgaaaaccaagctctgccaatggcgccaaagggtattatatgcaatccctctcgggactgtcacgaaaaaggggcgcggacacgtcagtctaaggtaaatacgttccgcagctttcgccgcactctttgcaaggcgttgtcaacagcttttgtagaggaaccgagttgcctggacatctcctcataggagtaggagctgagatacaatcttaatacctgccgttcaaatggggacaaaaggttttcaatccgccggttgcgtgcagcagattcctcgcttgcaatcaccagcttctctggatccgtctccggcgaaaccgcagcgagcaaatcctctggaatctcccgcccgctgagtgaaaggtaactgcgcatcggcgcgtttttgtcgcgcatgtgcgctgtcaccgcactgagcatcttgttgttgacacaaacagccgcaaacgtccgaaaactgccggctgtgtcctcccgataattgcgcaccgccttcagcagtgcgatcataccttcctggtagacatcgtcaacatccataacgccccgcgcataagcgcgtgcacgcatacaaacaagcggtgtgtaacgctctatcaaatcagccagcgcctcgtcgtcgccgtttttagcgcgttgggccaaggtttcgtcggcaacggcaaaagacgccgatatcgcccgatttgtcatagccgtcttactcctccgcacgcctgtcgcgaccaaccgaattgatagaaatattatatcctgcgcgggacattttgtcaagcttataaaaaaatacccagggcataggggacatttttttgacgaattctccaaaagagtgggatagacagtctcaatcccgtatcgtgatatcgcgcagccacttgaatccgccgatccgaaacagcgatatgattgattttaatatttcgtcgcatttgagcaccaggaataccgcgggcgccggccagccaaggccaagacctgtcaaaaaaccgagcggcacggcgacaagccacaaaaacactacctcgcagaccaaaacgaatttggcatctccgcctgcgcgcagaacgcccaccatgccgatagtggccaacgactggaaaaagacgataagcgccccgacatgcgtaatactgtgcgcaatggcaatggtatcggcggagaaatcataaaatgagatcacaaccggcccaagcagcaaagtgacaaccgccgagagaaccccaaataggaccgcaatcgccataaaggtgacagaacgctgtttcgcctgctcgtattcacccgcgccgatcgtgttgcccacgaccgtcagagcggcgttggcaacgccgaagatcgccactgtgacaagctggttgagcacggtatagatgctgtttgcggccacaaaatgcgtgcccatgcgcccaatgacaacggcgaccatcgacgcgcccattccccacatcagttcgtttccgataaccgggatcgagataaacacatattttttgtatagctcccggttgctcggcagcagatcctttagtgagaactggattttcttttcacgccacagcacataggcgaaggcaattacaaactcaaagcagcgcgccgtcagcgtggcgagcgcgccaccgcgcacctcaaggcgcggggcgccgaactttccgaaaatcagtacatagttgagcgatgtgttgacaacgagcgatgtcaaataaacaacgatagaaatattgactgttccaacggaacgcagcatcataatggcaatattagccatcgcatagagcggataggaccagcccaggatgcgcagatactgcgcgccatattcaatcacagccgtctcggttgtaaatacccccataaatcgctcaggaatcaacagggcgaccagcatgaatacaatcgatataacgaagccgaccttaaaggtaatcgcctggacacgcttaattacagcggtatcgcgcttgccccaatactgcgaaatcagcacattcgccccgcctgcgacgccgaagcagacgaccatcagcataaaccaaagctgatttgcaatcgacgtagccgataactgtacctcgccaagctgcccgatcatcaaggtatccatcattgaaaccgccacagtgatgaggttttgcaaggcaatcggaattgcaatcgctgccgtcgttttataaaaaatcttatctcttacgaataatgtcattttctccctctccaaaacagaatcacaaaaccgaaaaaggggcgggccgctttggcccgccttatatattcgcacatcctcgcggcacacatttattcagtggcgtagtccgcagcgatctgatcgacaacatccatgccctcaaacacaaacccgaacacggtatgcacacggtcaaggtgcggcgtgccgcccaatttcttataagcgtcgagcaccggctgcatcgatgcggcgaagtcgtccggcacgccggcgtccgcgatctcctgaatttgggtgttcagctctgaaatacgcgcctgaatctcctcgtcgcccgctccggaggcaaccatcgcgtcgatctgcttctgaccgacctcaacaatgcggttcatataggctgaaagcaaatattgctgctcgtttccctcaaggccggacgcggtcttggcctgcacaatgaaaaattggctcccgtttgtgttagccccggcattcgccatggacagcgccccgcggaagttatatgcataatccgaaaattcatcctcgaacggcgcgccccaaatactttcgccgcccataccggtaccggtcggatctccgccctgaatcataaaatcgttgatgacgcggtgaaaagtcaggccgtcatagtagccctccttggcatgagtcacaaaattttcaacggcctttggcgcggcatcaggaaaaaggcggatctttataacgcctgcattcgtttctatttcagcaattgggcaattggcgtattcgcccgttccattttgcatcgcctccatccgtgcggcgatctcgtcagccggcggcaacgggtcgatggaaagcgattcgcctgtttcagcggcagccgcagcaggctgtgacgaagccgcaccggaggacgtctgcgcagcggaagacgactgctcccctgagccagccggttctgtaatggtgattttaataatttgcgccagcttttcgttcgccgcagacgacgccccggatgatgcagcggactgcgcagcagaggaagatgtgccggacggcgcggacgacgacgcgccatcggaagcgccgcacgcgcccaagcccatagccacggccgatgccaacagcatagcgatcaatcgtttcataaatatctcctttatctgtgtggtttgattttacagtatatcatagtttaccccatttcacaaggaatcttctgtaaaccattgcgcgtataccgataaaaccaccggtgaaatccgcggttttcctgcaatgcttctgcctgtcatgtatcccccacctgtttgcgcaccaacgaacgtgtacaatcagaacgggacaactgtttttcagacacttcagaaaaaagcgcgtccataattctgcgggcctgctcctgcctccacgcggggaaacgttcgaatacttccatatatctgctgaaatcacggcgtgtacgatccttgatgatcattccggacacttcactctctcgaatcagctccggtacggtagtgccaattgaagtggcgatgtgttcgagcgtcgcctgtgttgggttgtccaccagtccgcgttcaaagcgactgacatacgattcgctcataaagcattcgtttgcaaactggctctgtgtaagcccgaccttttttctgtataatctgattttcttgcccactatgacccctatcgacataatgtgtcccccctgcatatttacaatacaggaaaatttgtggtgtgatgcgcccaaataatccgtcctgaccattttataatcctgatttgtgtgttagacacaattataaatcatctattcatatatctcattataacaatcttatgaacatttttccagtcccattttttacaaaattcgggccttttgtccgtctatatcgcttctttgaggatataccgctcaagtatatatcccatatactttgtggatattccacattatataaagattattacacagaaacacctggccttcataccttattggggcctttgattcgctgcctcaatcagcgggccgcaccgactagcctcgaatggccacgaagtccaaagctatatttgcaaatcgccggatagcctcccgaaaaaaagaacctgcaccggacataagcgcccgctccccttcaataggagcagcccgtcaggtataggttctatggaagcccgcttatttttctttcagcaagtcgcgaatttctatgagcaacttttcctcattggacggcgctggaggcatcggaggcgctttttcagctttgcgatggaaccgattgatccccttcaccatgcagaacacaacaaaagccataatcagaaaattcagaactgcctggataaaattcccgtatgtgatcgttgccgctcctatgctgacgctcagatcagaaaaagaattctcctttacaaatattccaataatcggcattataatgtcggcagtcagggaatcggcaatcgctttaaacgctccgccgacaatgactccaaccgccatatccatgacgttgccccgtgcaataaactgtttaaattcagagataaatcccgatcccttttcttttacattcatagattgtcctcccgttttttaaagtgttcagctcacaaagggactgttgatctgctagggcctgtttaaaaaatcgaatttgccgtctttttctgcaaacagcggcggattccgcgttaaaaagcctcgaaatttgaaaggattcctgcttttttaccttatattctcctactgtttgtgaactatttgacaattcctctattttcaaacaggccctaagccgcaccgaaaacaagagcgattttttgaaagcgaaaacgtaaacctttgttgcttcatgagtatattggacaaatttaaaagcaccgccgctttggaggctgcgactttgtcaacagtcctgcaataacactataacacctgcacacatataccgcaaccattcatttcgcaacaaaatgcggccggattatttccgcaagaaaattaacatctgtgtcataacaaagatgtatctgggagatatacttattgcgatataatcattctatatcatgattatttgttgaaaggaaaaaccatctcatgagccaattagacaattttatggccgtcttgaccggccgcttcgataatacagaacagtatgagcaattcaagcgaaagggcgtggaggatttcccccttgcagagcatgtcaatacagcctgcaatgaaaaaatcctgcatctgccggaagggttccaaggcattttcatggttgaggaaagctactacacggttggaaaaaagacacatgcttctccacatttattcctgtttacccaggagcctgaggggatcaaattaacctcctatgatattccccaaggctatgataaagcgaccttttcctatgataagatggggcaggtcgaatttgagacgttgcagaggtccgaaaaattcacgcccgctatttatgtacaaaagggagaagtgtgggagggcggcagtatcagtatgttctcccccgtcctcaaatttacactgttcgaacgtttttcgccaaggctgttggaagtatctgagacaatggagctgaatgggcggcgcacctttggatacgatgagccgattctgtataaaagaaagcaggaccaaagccctttgaacggttgacggcggcaccccgtcacataacaaaagggggcgcaggcgggaaaatcccgcctgcgcccccctttgctgctgttcactttctattgtaccgcggcaaaaccccgctccagatcggcaataaggtcgtcgatgtgctctgttccaattgagagccggatggtattgggcttgatcccctggtcaagcagttcttcctgtgtgagctgcgaatgtgtcgtagtggccggatggatgaccagcgactttacatctgctacattggccagcaaagaaaatattttcagattatcaatgaatctgtgcgctttctcctgtccgcctttgatttcaaatgtaaaaatggaggcgccgccatttggaaaatactttttatataatccatgatccgggtgatccggcagggaaggatggttaacacgttccacctgcggatgattttgtaagaatgcaaccacctttttggtgttttccgcatggcgttccaaacgcagagagagcgtttccacgccctgaagcaaaagaaatgcattaaaaggagagattgcagcaccggtatcccgcaggagaacggcgcggatataggttacaaaagccgccggacctgccacatccgcaaaggctacgccgtgataactcggatttggcttaacaatgggggcaaatcgatcgctggccttccaatcaaacctacccgaatccacgatgataccgccgagcgttgttccatgaccgccaatgaatttggtagcggaatgaacgacaatgtccgcgccatgctcaatgggccgaatcaaatacggggtcccaaaagtgttgtctatcaccaggggcaagccatgcttgtgcgcaatggctgcaatggactctatatcgggaatatcactgtttggatttcccagtgtctccagatagatagcttttgtattggactgcacggcatcttccaaatccgacaggctgtgggcatccacaaaggtggctgtaatgccaaactggggcagcgtgtgtgccaaaaggttaaagctgcctccgtaaatggtcttttgcgcgacaatatggtcccccgcctgcgcgagcgcctgaatggtataggtgatggctgccgcaccggaagccagcgccagagcggccgtgcctccctcaagagctgccaaacgcttttccagaatctcctgtgtgggattggtcaggcgaccatagatgttgccgggatcctccaggccgaaccgggcggcggcatgtgcacaatcccgaaacacatagctggtcgtttgatagatcggtaccgcccgggcatccgtagcggagtccggctgttcctgtcccacatgcaattgtaatgtttcaaatttgtagctgctcatttgacatacccctttcaatcatatcagtttagaaatacaaagccgggtctgccttcagctcccggataagaggtatggcgttttggtgcggctttcaccacggacgcaaaaaatgcatagtggtgcgtccggccatatcgcttgcccgggagtccaacattcgtccacagcggtagttgcttctcagcaagatcccaaaccatatggtcatgccgcttcccctttcataaacctattaaaatagtatgttagttattatactctctctggtcatttctgtcaagaatcttttcaaaaaatgccggcaggcctatatttacaacatgctttgatcgcttttaaacaggagaaaagctgcgaagcttctgtttatcgggccgcgccgcatttgcaattctccgatttccattttttccttttgatcaggcagggttgacagctatatccatgtcccgttttcctgcttaatcttcaaacagcggtgtggaaagatagcgatcacccgtatcaggcaacaatacaacgatggttttcccctcattttccgggcgtttagccaattgtatggcggcccaaacagcggcgccggaggaaatacccgccagaatgccttcactccttgcgatgcgccttcctgtggcaaaggcttcctcatttttgactgtgatgatctcatcataaatctttgtatccaacacagccggcacaaaacccgctccaattccctgaattttatgggggcctgcatcgccaccgctcagaaccggagaatccgccggttctaccgcaacaaccttaaccgagggttttttctccttgaggtaaccgccgactccagtcaccgttcctccagtaccgacaccagagacaaaaatatccacccgcccatctgtatccgcccaaatttcgggaccagttgtagatttatgggccgcgggatttacaggattggtgaactgtcccggaagaaagctgtcgggtatctgatttgccaattcattcgctttggcaattgcgcctttcatgcccttggcgccctcggtcaataccaattctgcgccgtaggctttcatcatacgacgccgctcgaccgacatcgtttccggcatcacaataataatgcgatatcccttggccgctgctaccgcggcaagaccaattcctgtgtttcccgatgttggttcaataatcacagagccttcgtttaacagacctctggattcggcgtcctcgatcatagccttggcaatccgatccttaacagagcctgcgggattaaaaaattccaatttgccgatgatgcgcgctttaagtccatcttcacgctcgatatgtgtcagctctacaagcggtgtgctcccaatcaattgatccgcgctggtataaactttgctcataatatcgcctccaaattctaaatcgatggatgatccgatcagcgcctcaacatcggcggagcttgcagactgtaaacaactgtgatacgccgcctttcatttaataccaataaaaatagtatttttgttggtattatacgccatcttttttgtaatgtcaatcctgatttcagaaacttttcttcctatattgaaagcatacctacctgattgtataataggttatggaaatcatttgaatggaggcgcttgtatgatgatctcgacgaagggccgttatgcgctgcgtgtaatggttgatttggcagaacatcaaggagaaggttatatccctttaaaggaaattgcacagcggcaggaaatttcggagaaatatctggaagcaattttaaaagtgctggtgcgggagcactttctgatcggcgtgcgcggaaaaggcggcggctatagactgagcagggcacctgaacaatatacagccgggagcatcatccggttgacagaaggctctctggcccctgtcgcctgcctggagccgcacgcgctggcctgtccccgcgctgcacattgccgcacgcttcccatgtggaaaaaatttgatcaggttgtgaatgatttctttgacagctatacgcttgccgacctgatggagcattcggaaaacggcggcgattttgtgatttgaagcaattccagcacgcggcggcgcctttatacgtcttgccatatatgctgtaatatgcgcaaggcaaccggactttgccgtttgcggccgccggacagcggcaaccgctgctttgcagagaatttcgcacgctgcgccgcagtcaaaacaggccttgccggttttactgccgctttgcggcacacaagaccaaacaggcttgtcactgtgttatgatgaaggggctgtaaaaagctttgcgccatcttcacagacataagttcacattttataaaagtattaaaagcctgatcgcccattggaggaattttcttgtattggtatgccattcgtcaaacgctcatccctctggagcaagagccgtcttcagatatgccggcagcggtcctgctcacctctgaagaactatcccaacagcctaaactgtccggtttggccgacgtgctccaccacacgcccgctgcacgcgacgcacgggtatgcaaagcggaggtgcgttcaaattgtctttctggcactctggttcttccgcgcactacaaaaaccggcgtcaggctggcctatgggtatctgctcaccagcaagcgagttgtgctggtagatgatacaggtgcgctccagtcccatataaaacatcttatcaaggaaaaactctggacaggtgacagcgtcggccgctttttttacaatattttggaattactgatcgccaaagatctgcatcatctggaagggatcgaggatcaggcagaaaagctggaggaccgcatcttgtccggccaactggatggattcagcgccgatatgacctgtctgcgaaaggaaaccatggcttggtttcgctattactcgcaactggatgacgtgacctgcgagctgcgggggagtgaaaacggctatttttcagaggatgaacagcggctgttccatatgctcgaggagcggatcgttcgtctgcgtcaggaatcacagcttttgcgggaatattgcacgcagatccaatcgatgtttcaatctgaaattgatatccggcaaaaccgtattatgaaaatcctgacacttgtcactacaatctttctgcccctgtccctgctggttggatggtatggtatgaactttacaggaatgccggagctttcatggaaatatggctaccccgcagtgattgtggtcagcctgtctattgtgcttatcagcctgtggatctgtaaaaagaaaaaattttggtaaaggctgctctttccccgctgcagacgaatacgactcgatacctgccccttctcttttccggttcctcctatttcgtcagcgcaaaatcgtgcgcttcacgcaaccagtccaacagctcatcgtcaatctgccccatttcagatataatcatgtggtgcgtccaacggccaggatacggctccacagccaacgctatccgaggcgattccagccggtgtgaaaggctgaacgatacaatcataaacacctccgggcagcccttcatccgtcggagagacacaaaagcaaatccatatcgcgccttaaaggtaatttgtgattgctgcacttttaatatagtgtcggggcactctgcccgaagtctgtcgcacaatatttcgtacagaggcagcgcgtcgggcatgggactgaaaaacatcaattcatctgcggtcatcttatccactccgttcgatcctgggcatggctccaagtgtaaggaaaggtcaaggctcaaagccttgacctttgtgttcgcctaaatctgtaccaatcggggagacttctcatgcgcgccgccatagccggccctgtaaaaccgcccattttaaaaacctgaatccacaaccgttgaacatcagccggcattccccggttatgaatataggttctgaaagcgccgcctgctgcgccctaaaaaaggccgtcctctcccgcaggcgtcagctcgtttcccggataatcaaacgcggctgaaaaacgcaacgcattttgctgaaatcgatcggagcgtcattcgacggatgctcaatcatctccaccaacatctccgcagcgcgctgtcccagccgctttttgggcaggtcgatggtggtaagacgcggctttacataggagagaatggctatattgtcagcgcccatgatcgctacctccgagggaatctgaattttgcgctcctgtagagcgcaaatcatgcctgttgccacataatcgctgtagcaaatcaccgaaaaaggcggcttgtgccgcctcagaagctgcttcatcacctcatagccgccctgctggcctatacaattttgaatgacccaatcatcttcctccttgatcccatgatccgccaatgcctgcctgtaaccaagcagacggttttgcgcggacggcagccgctccatggaattgatgaaaaagatcttgtttccatcataggacgacaaatattttaccgacatgtaggaaaccatccggtcgtcaacaaccacgtaggcgtcctgatccgggtcgatatagcctcttgccagcacatagggaatttgaaaattggtcagcagatcgcagctttcacggccgttatgcgacggtgtcaaaagcacgcccgccacattgagcgcgtgcaggctgcggatcagttcaagctcccgccgcgcgtcctggtggctgtccacaaagatcggatagtatccgcttgcggccagcgtttcctccatgccatgcagcattctggaattatagggataagcattgtcgcttaaaataattcctaccgtattggtcctctgttggcggaaatttttggcaacctgatttggcacatagttgacagacgccgcgtattcaatgatctctttgcgccttttttctgaaatatccggatgtccatttaacgcttttgagactgtcgtaatgctgatattcagtttctccgccaaatccttcaggcgaaccttttcttgcatatcagtgtctcctttaatcccatcgccccatacctcaaccgaggtgtcgccgtttatttaaaaacagaaaaatcgttggatttttcaaacagcctctaggccggcgacatgcgcccattcagtttctgcaccaccataacgctgcttggcatccgcttttcttcacatcccccgtcggcggaaacgaccagggccgccacggcgtttccgaatatgaccgcctgcggaagatcgtcaagcgtctgatagcttgcaatgacgccggctgagaatgcgtctcccccaccgaccggatttttgtcagcgtatggacaattcagctccagtgccggtacataacggatttttgcgcctcccacctgataggccgctccctcgtcccccattgtcaccaatacggccttcgcgccagcgcgtaagatatagccagccgcctgctctatggtttgtcccgggaagatatgcgcaagatccgatttgctcgccttgatgatggtcgcatccctgcagagcgtatcgatcacttttttgccgcgcggcgtaaggatggaaaaatgatgataggaagttgtaccgccgaatccgccgagatcaacgattacagtttttcccatccgcgccagacaccggcacatatcgagatcgacttcataattcatcggacagataaaaaatttccccgcatcaagatacgcgggaataatatcctcaaaattgatcagcggcgcggtacatgcgtactcgatgcttttgacgcccgcctcatcgtagatcaaattgtcttccgtattcaaattattccacaaaaccccctgaaggtcgacacgggcaaactggctgaggaaattttgttccagattctcctcaacataactgacaatgccaacctgaagtcctaattttgccatgataatggaggaatatgcgcaaggacttccgagcaccggcccgatgatacggtctacaaaaataatattttccttcacgatgtttccaatgacgacaacctctatatctatttgaactcacctctttgccgttcggaatcaaaatattgccggaaccattggagctgcgggcgcaaggttttgcttcaatgaaatcattctactccatatattgtctttagtcaagaaagtttccgtcccgaaatgcgggcagccggccatggcttcatagccatcgccggctgcttcatacgggttttatccgacaaaggcacggaccgcagaatagatggacggcacgtccaaaccgtatttttccaacagtttctccgccggtcctgattcaccataggtatcctgaataccaagctttttgaccggaacaggatatttttcggcaagcgcgtcgcatactgcgcttccaagcccgccaattacggaatgctcctcaactgtgaccacccgccctgtctttttggcagatgcggcaattagctgcgtatccagcggcttaatggtatggatattgattacctcggcgcacacgcccgcttcgctcaggagcacggcggcctccagcgcggggcagacacaaagtcccgtcgccacgattgttacatccttcccttcgcgcagggtaacgccctttcccagctcaaacgcgtaaccgtcaaaatcgttgaccaccggaacggccaagcggccgaaacgcagatatacaggcccttgatgcttgtaagcggcccggacggcggccctcgcctcgacatcgtctgacggattgactacaaccatcccagggattgtgcgcatcagcgcgatatcctcattgcactgatgcgtcgcgccgtcctccccaacggagatacccgcgtgtgtagcgccgattttgacgtttaaatgcggatacccgattgaatttcgcacctgttcaaacgcgcggccgaccgcaaacatggcaaacgagcttgcaaacggcaccaaccctgttgtcgccagaccggccgccacccccatcatattgccttcggcgattccgcaatcgatgaaccggtccggatacgccttttggaagatactggtcttggtcgctcccgcgaggtccgcatccaaaacgaccagatcgtcatgctcctttgcaagctccaccaatgtgtttccatagctctccctggttgcgattttctttcccatcgccatcatgcgtcccccattctgttcagttcttccatcgcctgcacatactgctcgtcattcggcgcgaccccatgccaggacgcctgattttccatgaatgaaacgcccttgcccttgaccgatcttgcgatgatcgcggtcggcctgccctttacagcgcgcgcttcgccgaacgcatccagaatttgtccaaagtcatgggcgttgatccggacaacatggaatccaaaagccgcgaacttttgatcgatgggatagggagagcagacctgccggatatcaccgtcaatctgtaagccgttgttgtcgacgatcaccgtcaggttgtccagccctctgtgggcggcaagcatggatgcttcccaaacctgcccctcctgtagttctccgtcgcccagcagcgcgtagacacgatacgcctttcccagcagctttgcggagatcgccataccgacggcggctgaaatcccctgtcccagagagccggtactcatatcgacgccggggatatgtttcatatcagggtgcccctgcaaaatggaaccgatctggcgcagattattaagctccgcggcgtcaaagtatccgcgctccgccagcgttgcataaagcgccggggccgcgtgccctttggaaagcacaaacctgtcccgttcaggcgcctgcggatttgcggggtcaatattcatttcgtgaaaatacagggcggtcaaaatatccgccgccgaaagagaaccgccgggatgccctgcccgggcgctgtgaatggaggacacaatccccctacggattctgttcgcggttctttttaactgcgattcgttcatattgtcaccgtaccggccgcattttcctccggcgtaccagagatctccgcacaccgaaaagcggccgccctttctcatatcattttaccattgggaaacgcctgtctcttttctccttcgatgtgggagcattgacagattcagccggcctgataaagctccagctttgtcccgttgggatcgtaaaaaaatgcatactgcctgccggtttccctgtcgagtgcgactgggccagttttgactccctggcttttcagatcgttcaccgactgctccacgtcctccacaagaaaggagagatgctccaggcccgcatgcgggggctgcttcgggtcaggcgcgctttcttgaataaacagctccaccagatactccccgttgagataaagctccaacttgtgacgcttcttttccggtgagtattgttcccgccggagtgtcaggcccaaggtgtgcacatagaattcgacagcctgcccgtagtcgctgcatacgatacagacatggtgcatcgaacggatatccaagcccataatgtccccctattctcggttttaccgccgcgctgaacagcctgctcccgtgcgaatcaagcgggcgcatacaaccgctgcgatcgccgacaaaagcgccggcaaaatcattcccgacctgatcccgatccgggcgatgacaaacgcgacggccggcgcgcaaacaatgaatccggtatagtgtgcaaagagcaccattgtgcttccaagacaggaacgttctccctcccattcgcacgcgatatcaagcgtaaacggaagcacagggccctccgcgcagccggcaatcccgcagcaggcagtcataatgctcccgctgcccgacagcacgcctgcggctgtggctgccgccgtgacgcaatgacagatcagaatcgtctgtttgcgcggcggacgaaaacgggccaaaatcagccgcgacgccgtgatgccaagccaaaagcaggagagcgcagccgcgccccaccgcggttcatggagatattctgaaatgtagcgcgtcacccacacagtgattcccatctgatgcgccccatacagaaaggcgcagaccaatagcaggcatttgcggcgttcccggagatatcctgccaaatcagcgcggtgaatctggtttggctgcgccgcaaactgccgccggatggacccggatgtcaagagcgccgccagataggccgcagcggctatcagggcggccagcgcgcagatctgcatgacgccgtaccatgcgacgccggacaggcgcatccagcggatgatgagcggccctgtcaagcccccgacaccgtagcagccatgcaagagattcatataacgtgctgaatcgctttgatagagatcggccatcattgaggaggccagggaatccagaaagccgaaagctattccatagacgaaaaaggctcccaaagccgccgcgaatacaggctgcatccccagcaggaaaaagacgcatggagtcgcgaccgctgcgattgccagaacggtgcttttacgcagcttaccaacaagaaggccgatcaaaaaaaccgcgcagagattgcccgcgctctgcgccgcgctcataagtccttgtgccgaggattcgagatgatactgcccgatgaaatccgacagcagcgttccctgagccgaggtgcagaaggcgcttaccagcatcatggcatagatgccgatggtgaaccgcagcttttcggccccgtttctgttcatgctcccgcctccgcccgcatgttatttggatatctgctccatatactccttgatcaactgctgtccgagcgccccgcccggatggctcagggcaaaattctgctttgtaaagccgcgcattttacagacaaccgtcgcaagcgcgtcgccgattgccagcgccccggtggagctggccgtaggagcaaggcccatatgatcgatctccggcccggcgtcgcagagaattttgatgtcggtcgcctcggccagcggggaatgcttatcctttgtgatcgagatcgttttggcgccgatgattttgagcggggccagcatgttgaggatctcagaggatttcccgctgttggaaatcatgatgacaaggtcgtcctttgtaatcatccccatgtcgccatgcagcgtttcacagctatggacaaaaaaggcgggaatgcccaggcttgccattgtggcggcgatctttttgccgatgtggccggtcttgccaagtccggtaacgattacccgccccttgcaatctaatatcgcccggcaggcctgtgcataggcttcgtccacctggcttttgacacgcagcagggcgtcggattccttttggatctgttccttacaaaaatcaatgattttctcatccgttaacgcttccatttcggacaacctctttcccttaaatttattttacaaccatattgcgcgaccgctcctgagatacaaagactgccatgatcagaatcaagcccttgatgaacagctgaatttccgaggaaagtccccacaggaccagaccgttggcgagcattttcagtgtcaaaacgccgatcagggttccgcgcacgccgccaataccgccccgctgggaagtaccgcccagaaccaccgctgagatcacgtccaactcgtagccgtcgccgaccgacggagagcctgaacccatgcgcgccgccatcacgacggcgcccagaccggtcagtaagcctgcaaacatgaacaccttgagcttaattttgtccacattgagtccgctcagcttggcaacgatttcatcgccgccgacaagcttggtgtaccggccaaacagggtgaacttttcaattaacagacagatgaaaaaaacgccgaatccgatgatcaaaatccaaggctttagtcccagatagattttcagcgacgaggtgaaagggatagaggtattcgttccgccgctgatcattgtcgcgcttgcacgggcgatcgacagaaagcccagggtgacgataaatgttgggaccttcagcctggtatgcgccaatccctgcatcaggtagatcagcatactgactgccattacaataatcagtgtcagaatcgtgctgccggttttggcaaacagctttgcagtcaggacgccgcagagcgccatcatggagcctgcggaaaggtctatgcttcctaataaaataatgaatgtggcgcccatggccacgatcagcaggtccatcgcggatccgccgattgtgagcagattggagacggtcagaaatttcccattgcaggtaagggaaaacagaataaacaggatgacaaacgccagcagagagatgtttttctttagaaatgttgtcagcttcgctttatgttcccatgtcataatcaaaacccttccttcttttcgttggaacgcccggccttttgcatcgggctggttgtgccgcacgcaaaatttgttcagaccatttttgccatgatcagttcctctgaaaagtctttccctcgggtaaattccccggaatttttgccacttttaaacgtatagatccgatcgcacataccgatcagctccggaagctcatctgaaatgagcagaatcgatttaccttcgtttttcaggcgttccaggaaatgataaatttcgtactttgctccaacgtcgacgccgcgcgtgggggaacagacgatcaaaaactcggaatgattttcgatccatttggcgatcactaccttctggcggttgccgccgctcaggctggagacgttggtcagttcggagggcgtcttgattcggaattccttgactgctttgcgtgctgtttcccgctcctttttgtgatcaatcatccccgcgcgggacatcgcagtcagattggcggacgagatattccataccgagtcgtagatcaaaaaaagtccctccgtgtcccggtccttcggtatgtagccgatatggctgcggattgcctccaaaggagatttcatccttccggatgttcccttatagatcagttctccgccggtggcgcgttcatagccgaacagcgcgcggccaagcgcctcggatccgcagccgccgatgccggcgataccgacgatttcaccggcgcgcacagtcaggttgatattctcaaactcgccttccatggtgaaatccctcagctctaccatgacctccccgatggagctgttgtcctcgctccggtagttttcggcggagatattgcggccgaccatgctgttaatgatcatctgaggcgtagtttcacaaacgttcatccgcgtaatcagcttcccgtcccgcaggaccgtaagccggtcgcacaggctgtagacttcgtcaatgaagtgggagatatagatgacgcagacaccctgctccttctgctcccgcagaagggcataaaggccctccacgctttccttggaaatcgcggctgaggtttcgtccaccaatagaaccttcgcgcgcactgaaagcgcccgcgcgatttcaacctgcttacgttcctcaaatttgagacttcccacaatatctgtcggcttgatgtggtcgtaatggtattcgtgtaaaatctccgcggcagccgcgttctgccgtttccagtcgatgccgcccgccttattcaaaaacgttttgtcccgccccagaaagatgttttcagccactgtcagattgaaggcaaaattgggctgctgcatgatgattgcgacgccggcttcctccgcttcccgggaggagcttggacggtagggtttttcgaaaagggtcatttctccttccgtcatgtcgtgaatacccatcaaaatctggaacagcgtggatttgccggcgccgttttctcccacaagaccgtggatttcccccgccttaaattcgacaatctggtcgctgttccagtccagcgcctttgtgccgggaaaatacttttttattcctttcaggaccagcgcattttccaaagtgctccctcctcggcttattttcagcagcccttgccgggactttgcccggcaagggctttgggcatcatcttatagattatggggaatgactgcctgtcaatccattgagagcatcgtttcaaaggaatacgaaacgtccggattgtagaccttgctgtactgcgaccagtcgatcggctccggattgtcaagatacttttcacggaactttgcaacattttccgtagtgacgttcagcagattgagctgagcgttcgctacgccgtcgtatgtaataccattgagggtatcgtaaagaatgacagacgccatagccggcatcatgtaatggcctccgcaggaaaaataaagctgattggcttccatcgacgcgaccgcgtcggacaggcagtccataccgccgaccttgacggaatcaatcgcgccagattcagtcagaacgttgaccgtggaaagcgccagtgaatcgttgtagcaccagacgccgtcaagttcaggatgtgcagaatacatgttgcggaaggatttgtcgccgtcatcccagttttcgcccgcgtaatcagattgaagcagcgtgacctccggatgctcctcaagcgcacgcatcaggccgtcgttgcgccccattgcgaccgaggttccctgaatgccgccgaccgctacgaggtttttgacgcccgcattgatcagtgcgatcgcttcctgatatccggcctcctcatcgttcggaccgatgaaagcgatataatcctctcccgccacaatatcctcatccggcagccggtcgatgataacgactggaatgctcttttcgttgcaggcgtttaaaatgcccgggacaaccgacgagtcctgcggagcaagcacgagagcattgatgccggaggaaatcatggtttccacatcggagagctgctcggcggtatctccgttgcaatcgtcggaaagcggggtgaagccgaggtcggacgaggccatcttaaagtagttgaccgcgttctgccagaactcgttgttgcttgtcgggaatgaaaagccgattgtgaaggcgccgcccactggttccgaaaccggttcggagccagcgtcctgcgcctgcggcgccgccggctgtgccggcgcgtccgaagcagagggggtggttgtcccgccacaagctgtcatggtgaataggatagccattacggtgataatcgccaaaaaagtttttttcatttttatcctcctctgtcattcaggttatgggacgatatggacgggagccttttcggcttatcggatttccggggcgtcatagtgcggaacaatatagttttccatatggcggccaacctcgacccatgaattcgtcttcatggaaagataggcgccgacgagcacgtcggttacaagggcgctgtcctccggtgtgagcgaaggcgcggttcctgtctccacacaatgcaggaaatgctccagcatggtcttataggcccagccgcgctttggatagatcgggacccaacgcttgggaacatatccgttcggctgcatgatgtcctcggaccagaaaagctgcgggtaacggtattcccgaacaatctccggaagctcattctgcctgaagtccttattcgtgaaaaccgccagcggtgcggtttggaaggggtttgtcgcctcggagccggtaaagatggtgccctcagtaccatagacctccgagatgttggaaaccgccggggagtagcggtcgccgctgatgacgccggttgcgccgttttcaaattcaatggtgatccagaaggaatcgtcaagctccgtgtaatcctggccaaacgccttgatgatacccataacgcgtttggggcggctgcccatcaggtacatcaaaagatccgcgcggtgcgcgccaagatcaaacagagcgcccgcgcccgcttcatgcgcgttctggcggaaacgcgtgaaggaaagctgctcatgatagagcgaccagccctcgtgcagcgaggaacgccccatctgcggccggccgataaagccatcgtcaatcagcttgcgggcgatcatattctgctcccaaaatcgctgattggtgccggccatcaggaacacgccctcctcatggcagacatcgaccattttccatgcttcggcatgtgtacaagcaaacggcttttcaacaattacatgctttttggcacgcattgcgtcaatggcttcctgtgcgtgcaggcggtttggagtgccgacgataaccacctggacattcttgtcctccagcatatcgtgataatcgacatacgttttctttggattccatttgcgggacatcttgtccaaaaattctgtgttggtgtcacagagcgccgccagatacgcattgggaagcgcctcgattgagggacaatgcccgatatccgctattgaacctgcgccgataattcccacgccgatcttgctcatatgcttttttcctttctgttgtcaaaactgtcgttgacgcccgggaccgcgtcctggaaagctcgggcttcagtgcagggaggagatacgttcctcaacactttgtttgtccggcatccgcttgaaataacagccgcccgggcgctgaatcacaattgaagcggtagcgttgccgttaatcaccgccttgtcgacatcccggctgtggcagtaggaggccataaaacccgctccgaaactgtcgccagctccagtgaagttgagcgaaccgtccggcgcttcgctgaccgcctggtaaggtttcctgtagcggatcgcgccgtcgccgatcttatagagtacgcccttgccgccgagtgtgacaaccacggtcctggcgcccgcatcgcgcagatactgcgccgcctgttcagcagttttgcccggaatgatcgaagcgagatcctcctcactggccttgacaatcgaacaattcttacagatggtattaacaaccatcttgccatattccgtttcgacggagtggcggatctcgctggttgcacctccgtatccgcccagatcaacaaacacggtttttcccatcgcatcaagctgttcgatcaggtcaagctccacctcgtaattcataggacagattttgaaaaaatcagcctccaggtactgatcgctgatatcctcaaagcgaatatcaggtgttttgcgggtatattccacatatttggtcccgtcctgacggtacaccagattatttgtggtggtatacgcaaatgggataaaaccggtccgatccagggcgtccaattcagagatcatgttttccatatcatatccatagtaggtgacaattcccaccttacagccttgagcggccatcaccaaagaggaataggccgctggactgccgatcactggaccaatttgcttatcgggatagacgatcgtttccttgatgatgctgccaatggtgactacatccaaattctttgccatactcattttcctatcgtcagtcgcactgcaagccagcggaccgtttatttgcctgcgataaaattgttgaccttctctttgcagacatcgtcggtaaactggacaggcggatgcttaaagaagtaagaggacggcgcttcgatcgctccggaaataccgcggtccttcgccagcatgcagcaacggactgcgtcaatgctgattccgccggaatttggagaatcctcaacctcgagatgaagctggagcttgaccggcgcgttgccgaacttggcgccctctatgtaaatttccgcggttttttgatcgccctgattgtccacaaaagcaaaaccgggagcaattgcggtatcctttttctttaaaattgaggagatcgcatcgtgcttggaaacatgtttcgtttctccgcgcatgacaagattgataaagtctgtgttgcccgcaaagttgagctgataggatttgtcaatccggatgccgcggtcctcgaacagtttggcgagcgcacggtggacaattgttgcgccgatttgacttttccagtcgtcgcccagtacagggatgccggcttctttgcattcagcggcaatctttggatccgaggcgatgaattcggggataccattaaccacgccgcactttgccttcttggcacaatctacatagaagcggaccgcatcatgggagccggttggcaggttaatgagaattacatcgaccttataatcgatcagcgcctgcgcgacatcaacaggctgctgactgtcatcgatggtgaaatagtccttaccataataatagcgcaggtgctcgggagcgccgtccagcacaggagcctttaaaacaggcgcattgaggaatggaacgtcacagattttataggcgcagtttggtttttcccaaatagcctggctgacatccttgccgaccttcttggaatcaacatcaaagccaacgacaacctggatatccgaaggttcatatcccccgacattgtaatgcatcaaaccgccgaccctgtctgcggtttcctggtccttgtaaaagacaattccctccaccaaggacgccgcacagttgccgacgccgacaagtccaagacgaatctttttgtttcccatgataaatcctccttgttctaattattgttatagttaacgttttagtaaaaggcgtaaatataaaaggctttatttcgccttccttcaaacatcaactttaacgttttctttattttagcaactagctaattttttgtcaattggattaaatgcaaaaacgtttcaagcttttttgtagtttctgctaaatttaaattttatagttctttattatggaatttttggaatatttgctctttttaacaattgaaatcctatccgtttattttaacaatatcctctatggataaagctgcaacaccaatacaacgatctacctattctccgtttctgtatgcagttgactcctgcttttaactattgtcaaggaatgatcgtctcttgaagataaaagcaagtgattccataatagtccaaagagggggaaaggcttatgaaatcgagtgatattctggcatggaacctgctacggcaccgttacgacaataatctttcacaagaggagttggcctggcggatcggcatggatgtaaagcgatatgcagaaatcgagcatgcacaggcgcatacgactctgctgacattggataagctcagccacgccaccggcatcccggttccggaactgctcacacctcagccttgatcatcggtgttcaggtatttgcttatacaaaattaagagatctatacttccgacatggttcattcggcatcagggctttttctgctgttctctctaaaatataccgtcgatttattgattttttcacaaatcaggcagaatattgggcctgttctttgtcaagaaccaattatgcctggataaaaattccacttcattttacaatgaccctaatgacttcaaggaggggccattgtggaatcaaaagatattttggcgcttaatttattgcgcttccgcaacgataacaatttgtctcaggaggaattggcctggaaaagtggactgagcgtgaaaggctatgctcagattgaacgtgccgaggttcaatcctcattgaaaacacttgataagctcagccggggaaccggtttatccgtccttgctttactcacacatccctctatctgacgccctaattatacatgttcctattgcttcagcctgtttatggcaggcttttttgtgctgctgtttttaaacacggtctttttagatacaaagaccgtgttaatgaacgtttatctgccgattaatttttgatgcggcgctgcgactctttacgctcggttatcaatttaaatcaccttcatcgtctgtgcgtattgcccgccctgcgggcgtatccacttagggaaaagcattcgctgcggcaagtacatcaaaagctgtcccaacggggcgattcgctccgccctctcacctatctgccgcaaacaggcaaggcgggagcagtttttgcaaaatacatatttccccagtaaaaacgtcatttccttatcggtgtgcaaccacaatcaagcaaacgccatcatcgaaacggttgttgtccccaaaatccaactgatcgctgaacagcacagcgatatgattgaaaagctttctgtaaccgaggaaatcgacagtctcaagggacgtataagcaccttggaaaacgttgtaaaaactcatacaacacaaatttcggagcttaaaaaaagcacaataataaaaatcagaacatcgggacttcagggtggcgtacgccaccctgttttgtgtatttaaatgtacatttaaatacgtttgtcaagaagtttaacactcttgagttaaaacacgattgattcaagcaattatttccataaactgttataaaacgagacaggtcattaagtgcacaattcaattcgaccgcaatttccgtacctaacggccaggacggcgctttcgtccctctctcaatttggcagagcatggattgagtaacgttaattttctccgccaactccgcctgcgtcattcctttaacaaaagagacgcccccacgcggcgttgactgccctgtatcaacgtgatatagtagtaacaccatcccgaaggaggctgcgccatgaacaacgaagaaaagattttagcaatcctgcaacagatgcaaggagacatttcaggtttaaggcaagaaatgaatgaacgctttgaggctgtcgaccgtcgctttgataaagtagatgatcgtctggatttccttgaaacctgcatcaacgaggccgcaaaggacacacagatgtctattcgccgacatgaaaaagagtatcatgaggccgtttgacctccttcacgccgccctagcgggcggcttttttatgctgtccgctaggctggtagaatccttttgctgttgcgcggccttgaaagccattccttcgccaaacgccagtagtttttctttttcaaaatcggtaagaactggtacgaatttcttaaacacatccagaatctcacgctctttgtctgacattttatccacccctttatgtgtttatgtgactattatacgtctctaaatcacataagtcaagtatttatttgttgacaaacgcacatttgtatgatattgttatttttagagaggaggtataaattttgtacaagcgcattaaggagctgcgcaaagctttacattttacccagcaagaatttgctgatcgtatcggaattaagagaaacacaattgctaattatgaaaccgggcgtaacgaacctatcgatgctgttatatctttaatttgtaaagaatttaatgtaaatgagcggtggttacgtactggcgagggcgaaatgttcttacaaatgacaagagacgaggaaattgcagctttcattggcggtgcgcttgctaaggaaacagattcctttaactaacggaggtaaaacataggaatatgaaaccttatttttatttgtatttaagttgtcctgttgttttgcacaattggagtgcatttatttggtgtcttctaccataaaaaccacaaaacccatatataacaatgttatatatgggttttatctaatttggtcgaggtgacaggacttgaacctgcggcctctgcgtcccgaacgcagcgctctaccaaactgagccacacctcgatgtggctgcccgactaggattcgaacccagacaaacagagtcagagtctgtcgtgctaccattacacaatcgggcactcttttttgtgttgtgttttgtcacgaattctattataccgcgtaaaaagaaaaagtcaatagcattcccacatattttcgccaaatataccatatttttttctgataccgcccatatcgttttgaacttgcttcgacttattgcgcttgaataaaacgtatgttaaactattttggcagaaattcgactgacatggctgtatgggggagcgatatgaaccgcatgatcaactggctgcaaaaggaacctgtcctgaccatttcctggattctggcattttgttcgatgctgcttgtgccgcctgactatcagtatgccggctacctcgacctacacacattatgtctgcttttttgtctgatggcagttatggcaggcttccagcgaatcggttttttccaccgcttgggacagttcatgctttcacggacgcacagcatccgccagttggaaggcgtattgatcctgtcctgctttttttcaagtatgctgatcacgaacgatgtcgcactgatcaccttcgtcccctttgcaattgaagttctgcacatggccggacaggaccaacggcttgttccggttgttgtgatgcagaccatcgccgccaacctgggcagcatggccacgccgatcggtaatcctcaaaatctctatttgtatgcgcattataaattttccgcgtctgtttttatacagaccatgctgccatatacaattgtttcccttgcctgcatgctgctgtttctatcgtttcaaaagcgaaccacgttatccatccagatacaatcaaaggacatttgtgccggcggcagatggcatgccgtgctttattcatccttgtttgtgttgtgcattggagccgtggtgcgcattgtaccgattccgattatggtctgtattgtcgcggccgcatgttttgctgccgaccggggtatctttaagcaggtggactattccctgcttttgacctttgccggtttttttattttgatcggcaatttaggacgcatccaaccgttcatcgcctttttccaagccgctgtaaacggtcatgaaatcatatgcgctattctagccagccaaattatcagcaatgtaccggcagctttattgctctccggcttcaccgagcagggcagccggctgttgatcggtgtgaatctcggtgggcttggtacgctgattgcctccatggcgagcctgatttcatataaatatgtctccctggccgttccaaaaaagcgcggcgtatatctgcgcgtgtttaccatttttaatgtgctgttcctgctgcctttgcttgcattggctctttgggggcggttttgaaacgttttgtcagattccccggtttgtctggcagcgctgctgctccggcatactgcgcttttatgatttcatattttgcagcagcggcatggatacatactccacatcccggccaaactaatgccatatttcataatttataggctttacggttttggcggtaaaaattttcagaaaaggcttgattgtacacttttttagtgtataatagaggtaatgattagatacttaatacaaggaggcaacgatatgtctgtcaaacatttttcaaacgatacatttcagtcagaggtccttcagggcagcggtccgatccttgtcgatttctgggcgccgtggtgcgggccatgcaaaatgctcggccctgtcattgatggcttggcggatgagttgtctggcaaagcggttgtcggaaaagtcaatatcgatgacgagccggatctcgccgccaaatacggtgtcgtcaccattcccaccatcatcttgttcaaagatggccaagaggtcaaccgccttgtcggggtccagtccaagctgacgctgacacagatggtcgaacaggcataaaaacgatccgtcccacatacagcgggctttcctgacaggaaagcccgctgttttcataagccatgtaaaatcaattctacagcggtttgaatccctctttatgggaaagaataaagaaagcgggctaattcactccgctgcgcagacgtgcagccggacaatccatcgcataaaacttcatgcgctgtgggcgcatcacgatcatagacaaaattggtgtcacacggccagtttgctatgcattttgcacagaaaacagcctgtgtatacagaacgttccttattaaaaatgtttgaggcgggtgtcaaaatgattgttgttgttgcgggcggtgaaaaccggcgtctgcgcgagttgctgcgcagcgcaggcgcgctttcaatgctgtgtacggatgctgcgcaggcgtcattttgcggagacggaccggatttaatttttctttcagcgcgcgagccgctgcgtatctcctgtgaaaatgcggctctagtcgttcggcgcggcgccggcttgccctcgggaatcgagtgtgaaaatcagatcgccatcgttgacagcgccgacgctgctgtgcgggagcatttggcgcgccggcgcctgcctgcgatcacctgcgggctgtctggagccgatacgctcacattatcctctctgacggcggacagcgccatgatagctctgcaacggcaaatcacagcttttgacggcacaaaaacagacccatttgaattgccggttttgtattcgcagcgtatagagacgtttgacctgctcgccgcagcggctgtcttttgcctgatggggcggcgcagcccgctttccggatcgtctgtttggcgtatttcagcaggcaacggttgattttggttatgcgctcaggaatttacaatcataatcctgcgaagcaaaaccatactattactgcaaacgcaaacaacaaatttcgatttgaaaagaaaattaaggagtgtatctaacatgaccagttccaacaatcctgttgtcccgcaggcccgcgaggctcttgataagttcaaaatggaagccgcccgtgaagtcggcgtcaacctcaagcagggctacaacggcgatctgacctctcgtgaagccggttctgtcggcggccagatggtcaagaagatgatcgaggcgtacgagaactccatgaagtaagctccccttttattagggaatgataaagaacgcgcgggcaatcgtccgcgcgctctttttttatccttcccgcagcaccagcacatcctccggcgaaaccgccagatgatccggtacgcccgcatatgcatgtttaccaattttccaccagattttttcagacgctgtgccggccgcgcgaaacaggatattccactcaaacggcccctccgaactgccgcagtcctcaatcgcaatcagatttggggcggaggctcccgaaggcggaaaaaatgaatgcgcgcgcacaccgacatggcttacgtcctctggaacgggatcggccgtatcgagcgaaatgccccagtcaagcgcctccacgtggtgcgcgccggcctttttcgcccgcgaaatatttttacatccggtcaggcgcgccacctgtacaagccctggcgaacggaataactcctttgtaccgccatgcgctatcggccggcccgcatccatcacaagcagttcgccgcacagacgatacgcctcgtcacggctgtgcgtgaccaacacggcatcctttccatagctttccaaaagctcaagaacctgcatctgcatctgctcccgaagatgcgcgtccagtgcggaaaacggctcgtcaagcaagatcacgtccggctcgcttgccagcatacgcgcaagcgccgcacgctgctgctgtccgccggaaagctgccccggataccgcccgccaagcccctccaaatgaaaccgtgcaagcagctccttgatcatctgttcccgcccattcttttcgccgtgcataccgcagacgatattttccgccacggtcatatgcggaaacagcgcataattttggaacagatagcccacgcgccgtttctgcggcggaaggttcagccgcacagacgaatcgtaaagcacacggccgttgaccacgacgcgaccggcgtctggacgttcaattcccgcgatgcaccgcagggtcatgcttttaccgcatcccgacgccccaagaattccaagacagccgccgtgcgttgtaaacgcagtttccagcgaaaaaccgcggaaccgtttttgaacagcggtttcgatcatggcttcgccttccttccgcggcggttttcctgcatggtaaaataattcattgccacaaccacaataaacgaaatcgccacaataatcgccacatatccatatgctgattccatattccccgcagctacggccgaatagacagccagcggcagggtgcgtgtttttccggcgatgtttccggcgatcatagcggttgcgccaaattcccccagcccgcgagcgaacgacagcacgccgcccgacgcaacgcccggcagcgccatcggcataacaacacgccagaaaatgcggccctccggcattccaagcgtgcgcgctgcgtcgaccatattgcggtctacctgttcaaatgcgccgcgcgccgaccggtacatcagaggaaaagagattacaacagccgcaattacggtcgcgctccatgaaaaagcgattttcaccccgaaataatcaagaaaaaactgaccgaccggccgcttgacgccgaagatatacagcaggaaaaagccggctactgtcgggggcagcacaagcggcagcgtcagaataccgtcgagcaccatgcggattcgggcgctgcgcagcccgacaacgagccgcgcgcagaacaccccgagaaaaaaagtcaccagaatcgacacggcggcggttttcatagaaatgagaatcggcgatacgtccatatggccgcccccttttgtttaatatcccttatacgttcggcgagaagccgtattcctcaaagacagcgagcgcctcgtcggacgcaaggaagtcagtgaacagcttcgcttcctcaggatgcgccgagttggcggtgacgccgaccggatagatgaccttttcggccaggctgccgtcaggcgcttgggccacaacgcgcacctgatcggtcgtcgcagcgtccgtcgcatagacaatcccggcgtctgcactgccctcggcgatccagcccagcacctctgttacgtttgtgccaaggctcattttcgccgaaacggcgtcccacagtcccaggtttgtcagagcctcttttgcatactggccggcgggtacgctctcaggatcgccgatcgcgaccatatcagcgtttacgatgtcctcaaacgcggagaacttctcggagccagacggttcgatcagaacaatcttgttttccaaaagttcgacgatcgaatctgaagccatcagcccctcatcattgagtgcattcatctgcttcatagccgcggacatgaacacatcggcctcaagcccctcctcaatttgggtctggagcttgccagagctgtcgtatgtaccttcaaccgtgatccatgggtactgatcctggaacatcgggatcagttgttccgtataggaatattccaggctggccgccgctgcgacaaggatcgttacaggctccttgtccgtttgggcctgtgaggacgcaggctgcgaggccggcgcagcctcagacggcactgccgatgagaccgccgcgggcgcctgcgaagaagtgctggatgccggctttgatccgcacccgccgagcgcagccgctgtgaccagcgccatgaatcctgccaatactgcttttttcatcatttgtttcctcctgtttgcttttataatccctgtgtcgcgaataattcgtcgaacacctcttggaccaatacccggctgcggctttccaacaacctgaatttttccagaagcgcgcgtccatccggcgtcagactcgccgcaccgccatttttaccgccctgctgccgcgcgaccatcacccgcgccgtctcctcctccagcacagacagcatcttccagcccttgctgtaggaaacgcccattcggccgcatgccagccttacggaacctgtttcatcgatcaaggtcaaaagctgcgccacacccggcccaaaaaatgcctgctcgcgcatcaggcgtactttgatatctggatacagccgcgcgcggttatggcgctccagctgctgcgcaacatctgcttcacgcgctaaattaaacagtacgccgctgtcgtccaccggcaagaaaacacgtctgtctgcaaaccgccgcagcgccccgcgcagcccatcgccgccctcataggccagaatgcccggcgccagcctggatgcaagcagcaacggatgacccgggtggccttcataaagcggactgacaatctgcccatccgacgccaacagcgcacacactgtcttgggagtgaacagtggcacatcaaccggcgcgaccagaacgcgctcacatttatccgcaagatatgaaagccccgtccgcacaagcgagaacatttgcaccggcccgccgttgggcggacttaaacagatcgcgcccgtgcgcgcgatgtttttttcaagcgcctgtctgttttcctgctgagaaacaagcacaatgcggtccacacccgcatggcggaaggtgtcgaccatgcgctgcgccacggaaaccgaccccagcttttcaagcggcctggtcaattccccctgtgaggttgtcccatccgcaacgatcatcgcacccgctgtcatttggactcctccttacctgcattggacttgtttttaaaaacaagtccattaaaagcagtataccacacttttccaaaaccggcaagcactattttttgtgaccgttaagcaaaaaacaggaggccgcgggcctcctgtttgcctagccgcgctccagcatcgcgagcgcgcggtcgcgtatccccttatcaaaaaagcccatcgcctgatccggcagcccgatgccgggcgtttgaaaaaagccgatggtatacagcgtataaaaatgaatcctgcgcgcatttcccgaacgcgtcgtcgcggtacgcttttcctcatccggacggatctcccgcacatccgtcagccggaccactatataggccgggctgccgccgcgcatacaggcgtaatgcggcgtgtgtgcaaaccaggcaggcgtatgattggattttgggccaaccatttcaaaatcgaacgactgggacggatcgctggcggcggcgatcatctcccgcgcaaaagactcccgctccgccgcatcagagagcagagtacaaaccgttttctccgccttgcgtgcaaaatgcgcgggacttaaccctggcaacagaatcgcaaaatagatcgacagcaccacggccgccataaacaagcctccaaacgccccataaagcgcgcccacagcgccgcccgagttgatggccgccaaccccgcgaacaatccggacgagccgatcaccgtgagcggcacaaccatgcgcaggctgcgcccgagcacctttgccttgtatcttcgcatccattcatattcgccagccaaccatgtctcaaatacattttgcacaaaagttcctcccccactatgtctattcagcctcaaagagcgaaagctggtccatacgctgcggccgcaaggagcgttcccgtatttcgtccgacggcgacggccggccgatgagcagcggtgaaaacggatcgtgcagggcggcgttttttgcagccgcgccgggcatcgtcgcataacagtatatgcatccgttccggcatgaatcatatgctccgatgtccacactctcaaggcaccggcaggcaggccgctgattttgatcggcgcgcgcgtcaatcggactgcctatcgcccgctcaataagcgcgcggtcgatgcatgcacccggcaaaataccgtatgcgctgaaatcgccctgctcggcgcaggtatacagcgcaacgccctgcggccgggcaagctcggcaaaaccgcgtgcgatcgactgctgatcgtgttcggacacgggcctaacggcgccgccgcgccgtttataggcgtcggcaaagctgaacacgcaccgctctgtaaagcctgccagacgcccgcacatgcgcccaaacgcctcgatatgccacgaaacgggatgcgccgtatccacgatgacagggtcgtaccgccagacaacacgcgccgcgccaagcaaatcggacagccgcaaaaaggcctccacaagcgtctgcttcggcggcaggcactgttccagctccgggccgtatggcgtcagggtaaactgaacatagaacggaaagcccatcgcagcgatctgtggaaacgccgcctccattgggatcggatttttcgtccaaaatacaatacagtcaaccacatcaggcgtaagcggcacgcgtgaaacacggtgagcactgtatggactgcgcacaagcgcatatcccgcatcaagccgccgcatcatccaagcgccgtagaaagccggtatatccgtgcgccggctcgcgctgacaatcacagaagcacgcctccaatccttatgaaagcaggccgcgcgctgtaaagcgcgcggcccgttgtctgcaaataccgtcaggcttctttataagcgccgtcgtacaggcagcaatcgtcccatatggacacatcggaacggtcaaagttctgcatggaaactgacatatattccgggtaagcaggctcgtcaagcgtgcaggagccgatctgctgtccatcgatataataggtgattttgctgccttgacaggtgatgttgagcgttttccaattttcatccgccgaaacatccgtctgcttgtcctcaaccggctgctccggcttcacagacgccgtccagccaagtcgttcctcaggattggcgtaattgaacatcggcacgccgtcgccgcccttcaccagcgaaatcgcaggctcaaaggtgatacgcgaaccgctttcgcccacaagctggacgccgaatacgacctttttcttgttgtcgacgatgcgtttgttatcaagctccggcagacgctgcttaacctctttatcatcacgcgccccataccaggtgctctccacatttaaacggatcgtcgcggaccacgaggttgacgatggacgctcacacttcagcctgcggccctgcatcgcatatgatttcgccttagcttcatcgtcacggttcgcgcgaaacccatccggtccgaccgccagatacagccggccttccgcataatcgaaatcttgcggcgcataattgtcaaccgtccaatcatccgcctttttataatcagaaaaatcatcctttgtcacagccgaagcggccgaaacgcccacagacgcggccattgcagcggccaacgccaaacacagcgcgctgtaaccctttttcatcctgatcgtcctttccattcgcgcaaaacgcacattatacgattagtataccgccgccggacagaaaaatcaaccattttccccattttgcgcatttgtgcgcagttgacttgccgccattggatggttagaatataatataggtatcttttcctgaaagtctgcattaaaattccccaaatgcagcactgtatcaacagcagacaatatccgcgcacacgaaaaggatcatccccacacagaacagagagaattaaggagagggcgtcacaatgaaagctctgatcaaaaaatgcgccgcgctggtcctggccgccgccacggcgctgtcgttggctgccggaattcaggccgcgaccacaatctattccgtcaaaatccagaaaaacagcatccttgtccaaaataagggcaagaccgtccagacctacaacgccaaaagcaccgacctgaccctttctcgggaagacggcgaactgcttttaggctataagaacgcgcagaatttatcccgcgatattgcgctcggcacacagagcaccctgaccgtcgaaggaactgtttcatcgctgtcgctcgatagcagcctgcccacaagtatgcgccttgtgctcgataccggttcgagtgtctccagtctgaaaatcgccgcgcctggaaaaattaccatccgcggcaaggtggatacgctgaccgtttcatccgcagcgcgcattaccgtatcgaaaggcggtgcggtaacggacgccacgcttacctccggcagcgctgtattgaccgcgggtacaggcgcacaggtgaaaaacgccactgtggtcaaaaaatcgtccgtctccggcagcggcatcggtacggtcaaggttcggggcagcgacagcgatgacgacaatgatgacgatactacgaccgacgacggactgaccgtcaaaacctcgaccatctccgcccgcagcggcgacacgctgcgcgaccttgaaagcgatctcaaccactatgtcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgtcaaaacctcgaccatctccgcccgcagcggcgacacgctgcgcgaccttgaaagcgatctcaaccactatgtcaaggtctatgatgaggatggcgaccgaatcgacggaaaagctgaatgggtttcgtcttacagcaccaaggtcaaaaaaaccggcacctttaaattcgatttttacccggatgacgacgattatgacactgtgcgcggcacgatcaaaatttctgtcagcggcggcgacgatgacgattccaccaacgatgacgggctgactgtcaaaacctcgaccatctccgcccgcagcggcgacacgctgcgcgaccttgaaagcgatctcaaccactatgtcaaggtctatgatgaggatggcgaccgaatcgacggaaaagctgaatgggtttcttcctacagcaccaaggtcaaaaaaaccggcacctttaagtttgatttctatccggacgacgacgattatgacgatgtgcgcggaagcatccggattgaagtcagcggcagcagttcatcaagcggtaaaaaggtccggctgtatgtctctccgatcacgctttcgtctacatcagagcgtctgcgagatctggaggatgagcttgaggacagcgtcaaggcatactatgacggcaactcggtgcggggagacgtttcgtgggaggattctggaagcacacaggttaaaaaaaccggcacctataccttcgtctttgagccggatagcagcagctataatgctgtgaccggcgaaatcaaaattattattgacacagattcggacgacgatgatgacggcgaatatggcaacgatgattacacgcttgaaattgaggatatccatacctcctcctcgaccaagcggcttggttcgctcttaggcgagcttgaggacgccgttgtcgcgcgcgacgacgacggcgacaagattgacggcgaaccgtactgggtcgactcctcaaacacgcgcgtgcgtgaaacagggacttaccgcttcaccttcacgcccaagagcagccgttatgatccggtcacagcgaaaatcaaaatttacgtcgattgaacctgaacataagagacagccccggcctgtggccggggctgtctctttatgcatataatgatgtatcaatcgttcttttcaccgtctttgtttacaaagaacgcgccggccatgtcctcgcccacgcagagatcgtttttaaaccgatacaccgtggtctgatcgtaacggctgcccgcgcgcagaattggacttgtccaggtccattctggatggttgacagcatccggcgcatactgtgtctccaggcagaagcccgcgtgattgccataatgcgcgccgccctttccgccggacgcgtcaaggccgttggccgtataaagctgcacgcacgggcaggttgtcaggcactccataaaacgcccgctcgcctcgtcatacgcctgcgcgcagacaaaaagcccgtcgtgcgcatcgatcacatagttgttgtcataaccgccataggccgtttttgctatacgttctccaattgtatggaacgtgcgaaaatcaagcggcgttccctccaccggcaggatgcggccggtcgggatgagcgcgtcgtccgtttccgtgtagctgccggcaaacaaccgcagcttttgcccgagcatatcgccggaatcgtggccggcaaggttgaaaaacgaatggtttgtcagattgcagatcgtatccgcatcgcagacagcctcataatgcagcgacaggccgttgtcctctgtcagcgaaactgtcagcgtcacatccagacggccgggatacgattcctcgccgtcagccataaacgtggtcaggcgcagctcgtccccggtctttccctgcaccacctccccgctccacagcttctggtccaatccgctgttgccgccgtgcagatgattgacgccatggtcgttgcaggcaagctgatactgctttccattcagggtaaagcgtcccttgccgatacggttgcagcagcgcccgaccgccgctccaaagaacgtcacacgctcccggtatccttcatacccgtcgtagccgagcaccacatccgccagcctgccgtcacggtccggcacaagcagcgtcagaatcagcgcgccaaagtcgcagatgtccgcacggatggttccgttatcaagcgtgtagcgcgtcgcctgaccggaatcggtcataaacgcgggggcttttgtaatttttgtcatgggctgtacctcccttggaacctgtattcacagccggaggatgccgggcaggcgaggggggttgtaaccgatcaaggcaaattttcgcaggcgggctgccgcccggcaagaaaatttaacacaaagcgggagccaaagacccgccgggacggttcctggcggctgtgaatacaggttcttgattgctttgttccattataacgccgccgcagaggtttgtccattgtgtccggacgcaaaaatcccgccgtctaaccggcgggattttgcaggcgttcctttgacgcgacgatcaaaagcgtgccgcgtttgaccgaaatgcgcgcagcctcgccgcagaattcattgctgacgccgatcggaaaggaaggcgtcaggactgcgtcgcgcagcggatacgcgacatgctcaagcgtaacgccctcgcagggaccatctgcagcgaatacggacagatgccagccgtccatgcgctcaatttcgatggagccgtttcgaacagcccacgcctggttgtcgtttgaaaggatcgtcccgcgcgcgccgttttcacacagaaaaacaagcgcctgcaaattcgcgatcgtgtgatcaagccgccccccgaacgccgcgaccatcacaaagtcccgataaccgcgcgcaagtccaagctttaaaccggccagcgtgtcggtgtcgtctttttcagccggcatccggctgaccggcagggaaggatcaaccggtccgccgtaggaatcgaaatcgccgacaaccagatccgggcgcaagccgagctgtgcgcacgccgtatagccggcgtcgcaggcgatcacaaagtcgccggacacgcgcacctgatcgcacagggaaagcggaccgcctgccacgacgacgcaccgcttttgtgcacgcgcgtctttgcggcggcaatacaccggatagacgctgtgcgcatggcgccgctcgcacgccgtacagtcgccgtggcgcgtacagccacgtgggcaggggcaatcgcttttctcgttatgcatgatcctttaattcccattcctttattttcttcgcgtcctcatacatcacgcaatagctcgcatgacgcgacggatggacaaggccggcgcgcaccgcctccagcacggcgcagcccttttcaaccgtgtgcgaacagcctgtaaatttgcaggctttgctgtacggcgcaaattccgaaaaacagccggccaattcctccttgcggatcacctcataccgttccagttcgacggccgaaaagcccggcgtgtcggctatgtagccatctccaaacgcatacagctccacatggcgcgtcgtatgccgcccgcggccgagcttgcggctggtttcacccgtggcgatagaaagacgcccgtcgagccggttgagcaggctcgatttaccaacgccggagtttccggaaaacgcggtgatgccgccggcggataacctctgccgcagcgtgtccagtccgctgccgtccgctttggatactgtaaacaccggcatgccggccgtccgatagataccggccagcgcgtccggcccgcccaggtcacacttggttacgacgaggattggagatatattcttgtggcacgcgatcgccatcagcttatcgatgaccagcgtgttcggcgcgggatcggccaccgaggcaacgaccgcgaacgtatccacgttggccagcggcgggcgcacaagggcgttcctgcgcggcagaatcttcgcgacaacgcccttgctttcgcccgccggctccaccgtcacgcggtcgccgacaagcgggctgacgccctgcttgcggaatacgccgcgcgcacggcattcatacaggacgccggcggcgtccacatagtaaaagccgccggtcgcctttacaatcaatccctctgtatcgttcattgcattcattccgtaaattcatccgaataatcgttgagcagatagtaacccttttcgtcaaagtcaagatcataaacctggtacagctcgccgtcaaaataaattttcacatccgcgtagccttccccgctgaaaaacacgggccaggttttcagctccgacgggttgaccgtctcattggcgacctcgacgccgtcctgcgttgccgtcattgtgaccatgcggttgaccgttgttggcagcttgatcagcaggcgcaggcgcacggtcgcgcccgcttcgcccgcaatcacaacgtcaacctgcgtgttcggggacacctgcgaatcctttgccgggctttggctgacgacaagcccctgaagctcctcgtcgtcgtttcgttcatcataggtgatcttgccgatctgaagctttgcgttgcgcagcaggctcttggcgtcctcaatgccgacgccctccagatcgggcaccgtggccagcttctcctcgcggccaaggctcttatagaccgtgaccgtatcgccgaccgacacctcgtcgccctcggccggaaccgtgcgcacaacgctgccaagcggtacggaatcgctgaatacgctcttttcctctggaaccaacccccattcggtcaggcgcgccttgacctgttcgagatcctgtcccgaaaaatctggcagtgtgatcgtctgacggcctttgctgatcttgacgcgcaccaccgaaccgaccttgacggccgtgcccgccttggggctttgttcaaagatgacgccctgctcataatcggggttgtaaaccggatcgccgtcaagctcgattttaaagttttcatatttgggcgaaaccttgacggcgtcgaatttttcacccaccagattcgggatttcctcctccgccacggtcgcaaacgggttgttgagccagatcatccaaccgataaacgcgcatgtgacgatgacaaacgccgccgtcacgccggcaagcaccggaatgatcggcgcgcggcgcggtttttgctttcgcaccttcttctccttctttccacggcgagcgttcctgatcgcgtcggaatacttgctctcatcgtgcgcacgcggcgcgctcagatatttgtattcaaacgagatggacggatcgcgcttaaattcgtcgatatcgcgcagcatctgcgccgcgctctgataacgctttttcacatccttctccatggcgtgcatggtgatctcctggaggccctcggggatcgaggggttcagctcgcgcgggagcaccgccttcgactggatctgtttgagcgccacggaaacgggcgtgtccgcttcaaacgggacacgtcccgtcagcatttcataaagcatcacgccgactgaataaaggtctgtgcgcgcgtcgatcgtgtcgccggccgcctgttcaggggagatataatgcaccgagccgatcgccttatcggtaatcgtgtgcgtctcgctgcgggcaaagcgggcaattccaaaatccgtgattttgatcgtcccgtccgacagcagcatgatgttctgcggcttgatatcccggtgcacgatccccttatcgtgcgcgtgctggagcgcccgcaggatctgtacggtgaaatgcagggcgtccttccatttcagaacgccttcctgttcgatgtattccttgagcgtgatgccgtcgatatactccatcacgattgactgcatcttatctgaaaagctcacgtcatagacgcgcatgacattcggatggtcaagcacggccatggccttgctttcatttttaaagcggcggcgcatatcgtcgttgaccatatattcttcacgcaggattttgaccgcgacaacacgatcctcaatcacatcgtaggccttatagacattggccattccgccgatgccgatcagctcggtgatctcatagcgaccgtcgagctttttgcccatgtatttatccattcaaatatcctcctgcttacatcgcggcaatgacggcggtgatgttgtccgggccgccgaccttgttcgcttcatcgatcaacaggaaaatatcctgctcgctttcacaagtcataatcaaatcgacatgttcctccggaggcgcgtaattataaagcccgtcggtgcacagcagcagtctgccggacgtatatgcgcactccacatactccagctcgacagcggcttccactccaagcgcgcgtgtgatatagttgcgtttcggatgctgtcgcgcctcctcctcgctgatttcgccgctttcgacaagcatctgcacaacgctgtgatcgcgcgtcagcctgcgcggcgcagcgccgctttcacacagataggcccggctgtcgcccacatgcgcgatgcaaagcatcccatccatcatgacagccgctacgaccgtcgtccccatgccgcgcaactccccgtcggcagcgcccatatcatgaatcactgcgttggccgccgagacggccgaaacaagcatcggcttgattgatgcgggcggcatccgcgcctccagcccgcgcgcaatggcgcgtccgatgatctcgacggccctggcgctggcaatatgcccgccgttctcgccgcccatcccgtcgcacagcacgatatatgccgtatcctcggaaatcacttcataaacaaaggcgtcctggtttgtcgcgcgcacgcgtccctgatcggtcgcgccaaaaattcgaatcaaagctgccttcccccttcggtcacgggcacccgcccgctggttgacgcatccgcgtcctgccgccgcaactgcccgcatgcggcgctgatatcagcgcccagctcgcgccggatcgtcgcgttgacgccgcgcagacgcagttcattctgaaaacgttcgatcgccgcccggtcgccgcgccgataacctgtttccgcaaccgggttgactgggatcaggttgacatgcgcacccatcccgcgcaaacgcgcggccaattcggcggcatgctccggcgcgtcgttttctccggcgatcagcgcatattcaaatgaaatgcgccgcccggtcgccgcgaaataatcgcggcacgcacgcagcagcgtatcgacattgtagcgcgcgttcaccggcatggaacgcgaacggatagcgtcgttcggcgcgtgcagcgatacggaaagcgtcagctggagcctgcgctcggccaatgcataaatcctgtcgaccagcccgcaggttgacagcgatacatgacgcaggccgaggttcagaccgcgcgggtccgaaaggatttcaagaaacgccatcacattgtcaaagttgtcgagcggttcgccgatgcccatcatcacaacgccatcgacgcgctcgccgctgtcggcctgcgccatataaacctcgtcaagcatctccgaagcggtcagatcgcgcacgcgcccgccgatggtcgacgcgcagaaacggcagcccatgcggcaacccacctgcgaggagatacacagcgtgttgccgtgatgataatgcataagcaccgattcgacacaatttccgtcgcgcagctcatacagatattttaccgtactgtcaatgctggaaacaagcctttttttgacgcgtatggcatttatgtagaacttttcagcaagctgactgcgcaacgccgccggaaggttcgtcatttcatcaaaatcagatacccgtttttcgtgcagccaaccaaaaatctgccccgcacgaaagcgcggcagtcccatttcggcagtcaatttctccatctgctgataagtgtatgatttcagatcaatttgttccatctttttcaccgctttttcagtacggatacgaaaaatccgtcggtatcctcgcccgtataaacacgctgctccacaatgttaaatgcgccgtttgtctcgtccaaaagccgctgcacaacccgctcgttttccgccggcaacagcgtgcaggttgaatagacgagcgttccgccgctctttaaatagtgtgtggaagtttttaggattttatactggatttccggcaagccctcaacggacttttgcggtttatatttgatctccggcttgcggcggatgaccccgaaaccggagcacggcacgtcgcaaagcacgcggtcaaagctgccgagcgacgcgtcgtaaacggccgcgtcgcccgcggacgcatgtatgatcgacaggcccagccgcttcgcgccacattgcaccatgcgcgcgcgcttttgatgcagatcccgcgcgaccagctcgccgctgttttccatgtgttcggcaatcgtgaacgactttccgcccggcgcggcgcaaacgtcgagcacacgctcgccgggcagcgccccaagcgccgccgcgcatagctgcgacgcgcggtcctgcacgtgaaaaagcccctcgccgaacgaagcaagcgactccggctcgacacgcccccttgccagcaggcagccggcgggcggctctgcgagctgcgcagcgacgccctccgcagccagacgttcacagagctgcccctcggacacgcgcagcgtgttcgcgcgcaggtaaatgggcggccgcccaagcgaagcgcgcaaaacgcgcagcgcggccgcctcgccataggcggacagccacgcttctaccagccacaccgggcaggaatattccacactgagacgttcggccgtgccgcccttcacaggcaaaacggccttgcccgcgcgtaaaaacgcgcgcagcacgccgtttacaaacccggacgccttcgcacagccgagcgcgcgcgtcaggttgacgctttcagatacggctgcataatcgtccacgccgtccatccagacaagctgacatacgccgagccgcagcgtctggagcaccggcttcgacagcgaggcaagtccgcgcgcacaataagcggcgagcacatggtcgattgtcaggcggcgttccagcactgtatagaacaatgcggccgcaaacgctccctcacgcgcgtcaaggccgtttttttcgatcagcgaatcaattgtcaaattggaataagcgccggcagattccatgcgcagcaacgcctgcgccgccgtatagcgtgcgtccttcttcatgcagtcatcctttttatacagtcgtccaacgatgttttttctctcgggcgggccatccggcttctccttcacgcagcgcccgccccgcagttcgcggcgcagcctgtttttacgcagtatctgccccgctgttcgcggcgcagccgactaaaattttttgccgagcttttttcaaaaagcggagaataccggcgcgtacaacatccacgccagccgcgctgcgcctgtcatggattttgctggcgcaaggccctgcgcctgaacaggctcttgcggcctgcggcgcgctctttacgagggctgcggcccggggctaagggcgctgccccctcactcgcagcctcccccaaaaggcgggcgaaaacttttgatcgacgcggcgtaaatcatattacgtacaacccgccccactgttcgcggcgcagccgaactaagtttttcgccgaagccttttttcaaaaaggctggatctagtcgcggcggcggttaccaaacaggagcacgagccttaaaagctgtgcgagcgctacgatgagcgccgccacatacgtcagggcggcggcccgcaaaacggcccgcgcgccgccaagctcgtccggcgcaagatatcccgtattttccagcgtcgcaagcgcgcgcgacgaagcgttgaattcgaccggcagcgtaatcagttgaaacacagccgccagtgaaaacagcaaaagccccagattgatcagcgccccggaggtaaacaatccaatgagaatcagcgggagcgccagcttcgagccaatatttgtaatcgggatgatcgcgtttcgcagcatcagcggcgagtaatgacgcgcgtgctgaaccgcatggccgcattcatgggcggccacgccgagcgacgcgattgaatcacccgcgtaaacgctgtcggacaggcgcaccacctgcgcgcccgggtcgtaatggtctgtcagtttgccgccgatatgctccacccggacattttgcagcccgttgtcgtccaaaatacggcgcgcggcctgcgcgccggtcatcccgtgcatattgcgcacgcgcgaataacggttgaacgccgacgagacggacatctgcgcccatcccgcaaacagcagcgccgggatcaccaaaattaaatagtagcggtcgaacggtataaacatctttcaagcctcccttgatcgccgtcagccaagcgtcttgccggcggcgtccggatggccgcgcagataatcggcggcggccattcgtttttttcccgcctcctggatttccaaaagctcgacggcgccctgcccgcaggcgaccacaaagcccccgcttttggccagcgtgccgggagcgcccgtaccgtcgggcgcaagccgcgagcggtagaccttgagcggccgcccgtcgagcgacgtatgtgcgacaggccaagggttcataccgcggatcaggttgtggacttcggccgccggcttcgtccaatcgatgcgcgccaattccttggtgagcatcggcgcgtgagtcgccagcgcgccgtcctgcgggacgcgcggcgcgcatccttcgccgatcaggcgcaccgtttccgacaatgcctgcgccccaagccccgcaagcctcccatacagttcgccggaggtttcatccggtccgagcggcgtttcccgcttcaggatcatatcgcctgtgtcaagcccctcggccatatacatcgtcgtgactcccgccgtccggtcgccgtttaaaacgctccactggatcggcgcggcgcccctgtattttggcagcagcgatccatgcacgttgacgcaaccaagcggcggcagctccaaaatatcaggaggcaggattttcccataggcgaccacaacaatcagttcgggggaaagctcctttaaaagtgcaagcgcctggccgtcgcgcatctttgccggctggtaaaccgacagcccgttttcaagcgcgcaaaccttaaccggcggcggcatgagcttgtaaccgcgtccctgcggcttatccggctgtgtaaaaacgcccgcgaccgcgtgcccgtcgctaatgagacgcgaaaggcacggcacagcaaattcgggcgttcccataaatacaatgcgcatcctcgtttcctcccccagctattcctcgacgatctcctccggatcgagcatccgttcggctttgtcgatgaacaaaataccgtcgagatgatctacctcatggcagacagccacggcaaaatagccctcggcctccaattcaaacggttttccataacggtcctgcgccttgagccgaagctgcgcgggacgatgcaccagcccatattggccgggaatggaaaggcagccctcgccgccgcactggtcgcccgactgttctacgatcacgggattgaccagctcgtgcttgccctcgcccacgtcgatgacgacggcgcggcgcagaacgcccacctgcggcgcggcgatacccacgcccccgtccttcatcgtctcatacatatcatccaacagcgtccagaggcgctcgttaaaatcggtgacaggccggctttttttgcgcaggcgctcgtcgccctccttgagaatattgcgtaacgccataagaaatcctccttcatattatttgccccggggcctatccaaattctcaaagtatatggattggctcttacagcgcgctttcaaaccgcggatcgatcgaaagcgcgacagaatggtattcacgcacggcaagatatttctgcacagtccgccagagcagctcgcgcgtacgcgcgttccagcggcatttgaccgccatacgccagcggtaccgtccggcgatctttaaaatctggctctcgcacgggccaagcacgcgcagcggcaaatcagcgtattcgctctgcgcgagcgccgtcaattcctgcaaaaagcggcgcgcggccgcgcgcgtctcgccgccccgctgccctgaaaagccgatgcccgccatatcgcagaacggcggatacagatgcaggcggcggctttcgatctcctcctcataaaacgaatcgtaatcctgcgcggctgcaagcgcgatcacaggattttccggcgtgaaggtctggataaacgcgcggcccgccttttgggcgcggccgctgcggccgaccacctgtgtaaacaatgaaaacgcccgctcaaagctgcggtaatcctgcgcatacagcgcggaatcggccgacagcacgccgaccagcgtcacatttggaaagtcaagccccttcgcgaccatctgcgtcccgattattatatcatattttccggctgaaaagtcggcaaaatgcttttcatgcgaaaatcttgccatagtcgtatccatgtccatgcgcagaacgcgcgcgtctggaaacagctctcccaattcctgctccaccttctgagtgccggcgcccgaaaaacgccggaaccggctgccgcatgacggacagaccgcatcggcgcgcgctgtatagccgcagtaatggcacatcaaatggccgttggcgctgtgatatgtcagcgcgacggaacagttcgggcattcagccacggtctggcagacagcgcatttgacaagcgtgttgtagccgcgccggttgagcagcaggatgctctgttcgccgcgcgcaagattctccccaagctcgccaatgagctgtggggaaagcgacgcgctgcgcgcgtccggctcctgaaggttcatatccacgattgtcacatccggcaggcgcgcagcgccgtaacgcgcgcgcagcgtcagcagcgtatagtcgccgcgcctggcgtgccagaagctttccgtacacggcgtggccgaggcgagcagcagcaggcagttatgccacgcggcgcgccggcgcgccacatcgcgcgcatgatagcgcggcgactgttccgatttatacgtcgattcctgttcctcgtccatcactatcaatccgagatcgcgcaccggcgcgaacacggcgctgcgcgtgccgacaacgatctgcgcgccgccgtcccggatgcgtttccactcgtcgagacgctccgtcatggaaaggccgctgtgcagcacggcaacgcggctgccgaaatgccgccggaaacggtcgaccgtctgcggcgtcagcgaaatttccggcaccatcacgatcacgccgcgcccgcttgcaagcacatggcggatggcgcgcaaaaagacctccgtctttccggagccggtcacaccgtaaagcagcgccgtctgcggtttgccgctgtcggccaaaccgcagagcgcatcgcaggcagcccgctgctcgtccgacaactcgatgccggcggccgtatcgcgcgccggaccggcggcgtatgggctgcggtaaacctcgcgcgtgtaatactgtacgacgcccgccgtctcaagccggtccacgaccgatttgccggccgccgcaaaataacagacctctttcagcgacgcctgtccagcttgcagcagaagttcgacgaccgctttctgcttggcggtgatctttaccgtcacatcggaaagcgtctctattccatcggccaggcgcaccatcaccagcttgccgtcgagaacgcgctggcggacaagctgcgacttgatcaaaagcccttccccgcacagatcgcgcagcacaggcgcgtccggcgcgagcgccagcgccgcgcagagcgtctcctcccgcaccggccggccgcgccctttcagatactcgaacacacgccgccggtctccgtccgcgccgccgggcagcacagcgccgcggggcagcaggtattgatattgcagccgaacgcccgcgcccggcggcagcagcgcgcgcatcgcgtcaaaataggtgcagaacgtcgtttcacgcagccagcgcgccagcgcgagcatctccgcgtcgagcaacggtttttcgtcgacaagcgatgcaagcgtttttgcccgctgcggcgccggcccgtcagccgtctccatcacaatgccgaagcgcgtgcggttgccggcgccgaacggagccgtcacgcggcaaccggggcgcgcgtccataccgtccggaatcagatatgtataaattttatcaaacgacagcgcagcgttttcaaccgctacacgcgctacacgcgccatccgaaacgccctccttgcaacgcaaaccgcctgttaaaaagcatccagctttttttgcagcgcgtcaataaactgcccgagatgcacgccgtcgacaagcgcgtggtgcgcctgcacggaaaacggcagcagcaggcgatccccaagccaaaaccagcgcccccacgagatcctggggattgcgtcgtcccggtccaggttttcggcgtgcgtcagcccggtaaagcagagccatggaatcgccgagagatacaggcagtcgtcgcgcgcctcctcatcgggcaggaaaaaccgctccccctgccgcgcaatcgcctcgctggtacgctgcaaaaacacatcgagcacgccgcacagcggcacgctgacatatttatgcagtgcgccgccggcgcgcggctcggtaaacgagggatgaagctcatcgtacagcacaacctgaccgcccttgatacgcatacgcagttccggaacctcgttggccgcgtgcgtcacaaaaaagccaaacgtatggctgaatgaaatcccccgttttttgacgcgcgcatgaaaatgcgtcacgtcaagctggacgcacacgctgtactgcggacggtcaagcgaacgataaaattcgaactgctccttgcgcggccaacaggccagatcgatgtacgccgtcatgtccgttccctccgcattgccagcagccggtcgaagatttcatcggcaagcgcatccttgcccatcagcggcagtttctcagcgcccgccttggttaagagcgtaacggcattcgtcggcacggcaaagccagcgcccggttcattcaggttgtttgccacgatcatatcggcatgtttcttttccagcttctcctgcgaatgcgcaacaaggtcgcgcgtctccattgaaaacccgcagagcacctgccccggcgcgcgcgtctgtccaaggtacgccaggatatcgcgcgtgcgctccaattccagcgtcatcccctcggacgcgccctttttgatcttgtcggccgccgcggtcctgggcctgaaatcagcgacagccgcacatttcacaatgatatcctgtacagaagcgcgcgacgcgaccgcttcaaacatctcctgcgctgattcaaccggtacggcttcgacaccctgcggagcagcgagcgccgtcggcccggtcacgagtgtgacggccgccccgcggcggctggcggcggcggctacctcataacccatgcgcccggtggagcggttgctcaaaaaacgtaccgggtcgactgcctcacgtgtcgggcctgccgtgaccagcacgcgcagcccagccatatcctgcggcgccagcgcgcggcgtaccgcctcgaacagcaccgccggcgcgggcagccgcccgcgccccgtatcgccgcaggcgagcaggccgctgtccggctcgagcaccgtcacgccgaagcggcgcagcgtctccagattgcgctgcgtgatggggttgtcgtacatcccggtgttcatcgcaggcgcaaccagcttggggcaacgcgccgcaagcagcgtcgtcgtgagcatatcgtcggcaattccagccgccattttcgcaatcacattcgccgtggcgggcgcgacaatgaatacatccgcttttttcgccagcgacacatgttcgacattgtactcaaaattgcggtcaaacgtgtcgatcgcaacgcggttgttgacgagcgtctcaaaagtcagcggcgtcacaaactgcgccgcattccctgtcataatgacgtgcacatcggccgccgtcttgccaagatcgctggcaagctgcgcagccttgtatgcggcgatgcccccgcttacgcccaaaacaatcgttttgccttcaaacatggctatcctcccaccgcccggctgcatctccgggcctgtcaaaacaaaaaagccctgtacacgacagggccctgtatccgttattccgaaatctgagaaacgtggcccactttgatcttgccgccggcaaattcctcgacagccttctggaccggcttttcctcattcagggagtgttcctcctcctgctcctgcgcgatctcacgcgcgcgctttgcaaccgcgacgacaaaagaataataattatcgcccggcttgataattgaattgatggagggcctaagcatactcatgaaattcacacaccttatcaatcatagtttgcatatagttcgtccggcatttcgacgcgcagataatcgcgtccaactgcgcgcgcgctttgtcggcgtcgtcgttgacaatcacataatcgtactgcgccgcataggaaagctccagccgcgcggccgcgagccgccgctcgaccacctcggccgtctcggtattgcgcccggtcaggcgttcccgcagcgtctcatacgacggcggcaggacaaaaatgaacacggcctgcggaaatgtccggcggaccttcatcgccccctgcacctcgatctccaacaggacgttgcggcccgcggcgagctgcgtctcgacagcagcgcgcggcgtgccatagcaatttccgctgtattcggcatattcgagcaagccgccgccggcggccagctcgtcaaaccgctcgcgcgttataaacgaataatcgatcccgtcgcgttcgcctgggcgcggcgcgcgcgtcgtcacggagacggaaagaaccgtctccggatgcgccgccaggtacggcgcaaggatcgtccccttgccgacgcccgacgggccggaataaacgatcaaaagtcccggctgcatagcttcactcatcgtcctcaacctcgtcgtcctcgtcgaccaggcggtttgcaaccgtctccggctgcaccgcggacaggatcacatgatccgaatccgtaataatgaccgcgcgggtccggcgtccataggtcgcgtcgaccagcgtcccgcggtcgcgcgcatcctggataatccgcttgatcggcgccgattcagggctgacaatcgccaccaaacggttggcgcacaccatattgccaaatccgatattgatcagtttcatacaaatgctcccctccgccgttccacgccgttgtactcaagatatccggcgcggcggtccggttttttgtctgctaaaagatcgcggctgtgttattcaatattctgaatttgttcacggattttttcgatatcgcttttgatttccacaacgacctgcgcggtcgcggcatcctgcgccttcgaaccgattgtattagcctcgcggttcatctcctgcacaagaaaatcgagcttgcgcccgatcggtccgttaaacgcccccaggatatcgcggaacgacgcaatatggctgcgcaggcgcaccgtctcctcatcgacggcgatcttgtctgcaaagatggccgcttcggtgacgatacgcgtctcatcgatctggcgatcctccaaaacctcccggatcttcgccgtcagacgttcgcggtatgcagcctcggtgcggggcgactgctccgccaccgccgcgacccgcgattcaatgctttcaagacgttcgagaatatctgcttttaggcgttcgccttccgttgcgcgcatggcaataaaccgttcaatcgccccgtcggccaccagccggacctcggtccagattgtctcctcatcctcctgcacgcgatgcacggaaaacaagtcggaaaacctcatcagcgaagaaaccgtcaagtcatcctgaaggctcagcttctcccctgtaacgcgcatcgcattgatataggaagcggccagctcgtggttgatatcaacagccgtatgcgcggcgccggtatcgacaaccgtcacgccggcctcaacttttcctcttgaaattttaccctgcaaatatcctttgagtttttcttccagatatccaaacgcacgcggcacgcgtgcggaaaattcaaagtaacggtgattgaccgacttgatttcaactgtgatatcacggccatctatagattgctgcgaccggccgtagcctgtcatgcttgtaaccatggacccaacctctcctttgtgagcgggccatgtttggcctcacatcttaatattcctattttacttgtattttactaatttgtcaacgcacggctgcctgaaacataaaagctcctcaaaccggacaaatctccacattttatgccttctgtctgcgcattcttctgtccatgaagccttgaggggcgcgtcccaaaggacgcgcccctcttatacctctatcagacgggatgcactttgcttgccttatcgccatgcttgccatccacgccatactttttgttcttgcgggattcaaagaacttgggggccacctgcgggaacatcgccattgtgaggatgtcctcctcctgctcgagatattcaggcgggaacccggcgcgcagcttctccatctccggctcgatcagatcggccgggcggcactcgatcggctcctcgtcgcccaggatcttcttgcgaaacgcgggatcgatcggggccggcgtcctgccgtattcacccttgacaagccctttgaattcctttgtaaccatcttgtaccgctcgcccatgatcacattgaacacagcctgcgtacccacgatctgggaggtcggcgtgacaagcggcggatagccggcgtccttgcggacattcgggacctcgcgcagaacgtcctcgaatttgtcctccttgccggcctgcttgagctgcgaaaccaggtttgacagcattccgcccggcacttggtaaacaagcgtattagcatcgacgcccataaccttcggattaagcagtccctccgacagatatttttcacgcagcttggcgaaatgcgcccgcacaacatcgagttttttcaaatcaagccccgtgtcatacggcgttccctcaagcgccgcaaccatcgattcggtcgccgcatgggacgtgcccatcgcaagcggcgacatggctgtgtcgatgatgtcgcagccggcctcgatgctcttgagcagcgacatcgaggcaagcccggaagtataatgcgtatgcaggttgaccgggatctttaccgcctttttcagcgccgcagtcagctcataggcaaccgacggcgtaatcagcgccgccatgtccttgatacagatcgaatccgcgcccgcgtcctcaagctgtttggcatacttgacgaaatattcgacattgtgcaccggcgacagcgtgtaggaaatcgctgcctgcatgtgcgcgctcgtcttttttgtcgccttgatcgacgcctccagattgcggatgtcgttaagcgcgtcgaaaatacggatgatatcgattccgttgtcgaccgatttctttacaaaatattcaaccgcatcatcagcatagtggcggtagccgagcatattttgtccgcggaacaacatttgcagctttgtgttcggcatatttttgcggatcacacgcagccgctcccacgggtcctcgtcgagaaaacggatacacgcgtcaaacgtggcgccgccccagcattcgcaggaataaaagccgacctcatccatcgcgggcaggattggaagcatctcgtcgagacgcatacgcgtcgcgatcagggattgatgcgcgtcgcgcaggatggtttcacaaatttttaccttctgagccattgatgtttcgcccccttaaccgatggagatcagcaggtcatcggagttgacggcatcgcccttcttgacatgaacgccgacaaccgtgccggtggccgggctgaagatctcgttttccatcttcatcgcttccagcatgagcagcaggtcgttcgcctcgacatggtcgccctccttgaccttgatatcaagaatgttgccgggcatcggggccgtgacctttgtcgcgccggccgcaggggcggcggagggggcaggggcaggggctgcaggagcggccgcgggcgcggcggcaggagccggcgcgggggcagccggagccggagccggtgcagcgtatccaaccggagacggaaccggcgacgggatcgcggacggcatcgcggcagggacgggcgccggagccggcgcgccgggagccatttcatcaacctgaacatcatacgctctgccgttaacaactatattaaaccgtttcataacaaatttgcctccttataatgatcggggtccgccgcatcggccggcagcccatgtgtggggcggcatacccgccgctgctgatacaggatcgcgcgccgcgcgggcgcagttacatcgggatattggcgtgctttttcggcagcctgctcacgcgcttgccaatcagcatatcaatggcagaaacaacagctgcacgggtattggccggatcgaccacatcgtcaatatgtccctttgcggcggccgccacagcgcccgcctcattggccgcatactcagcttccacctgcgcgcgcgtcttatcctttgtgatcttgtcgccttccatgaaggcaacggccgtcgccggggaaagcgcgctgatcacagcgtcaggccatgcgacggcataatcggcgttcgcaccgcgaccagccagagcgacataggcggaaccgtacgccgcgccgcagatcacagcgattttcggcgtggtcgcctcagcataaacatgcgccagctttgcgacctcgcgcacaccgccgcggaacgcatggccgtttactgcggcgaacccggcgcagttgacaaatgtaacaaccggaatctggaacgaatcacagatcgcaacaaaacgcgcaatcttgctgctgccgttcgaacagaccttgcctgaatcagaagccgctacaaatccaaccgtcgagccggccactgtacccagcgcgacatgcacgccgcactttgtgaaatctttttgaagctcgatcacgctgcccgcatcggcaacactgccgatgatcttcatcatatccgccttgtccatcgccttggcggctgcttccaaagcagcgtccgctccgtccgcttccctgaattcacacagcggcagggccgaaaggttgttggagggcaaaagcgcgatcaacctacgcgccgctgcgacagcggcggcatcatccttctcaacaagatgcgccacgcccgacagcgcagcgttcttcgcgctgcacgcctcatcgccgggggaaagaaacagctccgcctgctcgctgatcactacgaaatccgccgaagccgcgatcatcgccgcacagccggcgcacggaccgagcaccacggaaacctgcgggacaacaccggaaaggttgttcgtccagcagagcatatcgccgtaggcggccatcgcgtccagtccttcgtcgattgccgcgccgttggaatcataaataccaacaaccggcgcgccggtcttgagcgccagctcgtaaatctttttaattttggagccgtgtgccgcaccgaccgcgccgttgcgcacggaggtgtcctgtgcgaacgcgtaaaccgggctgccgtccacaagcccatagcctgtgataacgcccgcgccgtcgcagccgtttttgaccagagcgccaacctcgacaaaagtgtcggagtcaaagagggccgccatccgcttgcgggctgccgtgtccttgagcgcgtccttgcgggcgtcgtccagtggcatcgccttgtcactcatgtttttatcctcctatctgattcgtcatccacacaaacggaattttgtgtggacgcccgcccggccggacggggaaaaatgcaacaaaatttaaaatcttatgtggactttccacattcttggttttgaaaacatcaaaatctaaccattttaaagtatacacgcttcaaactcaaataacaagcattaattgcgtttttttgatgattttttaacgaagatattttgcccttaaaaatccccctgcctgcggctgccggacgtgcagtttttgcgcgcaaaaaacgcgtcgagtgaaaacggcgcatccgcctcatatccaagcttcgtcagcgccaaccgcagctccggcgcaaggcctgcgccgatcctggccgtctttgtgcctgtcctcgacacagccgcgaacgcggcccgcgccatcccgtcgataagccccgcgtccatacgccgccctgtgtcggcgccgcatagtgtgacacagccgccagccatcgaaaaagccgctgttgcgagcacatcgccgccctgaaacaccccgtaggcgaacgcgccctgctccggcgctccaaggctgtcgcagacgcgcgcggccaggcgcgcgtccgcgatccgtttaattgtcagcataaaaaccacccactccgccgcacaaagcggcaaaactatgaatcaaacgccttcccgggctgattgcatgtatttattccccgctattacaaaccgccttacaaaggcagggtaaccggcgattttcctctttccctgccccggccatggtatgcgccgcatataaaaataaccggcgggcggccgcgcggcccgcctgccggtgtttcactcggacagtccgcccgcctgctttttcgacgcagcattgcgcaacgcggccacctcccccggacgcagctcgcgccactgtccgggctggagcatgccgagcttgagcggaccgaccgatgtgcgtttgagtcgcgcgacttcaagcccgaccgcctcgcacatgcggcgcacctgccggttgcgtccctcctggatggtgatctgcaaaacaacacgcccatcctgcttttcaagcacaagcaccgtcgccggaagcgtcatgcgcccgtcgagcatcacacccgcggacatcttcgcagcctgctcgtccgagacatccgggcgcaccgtcacgcggtacgtcttggagatatggttcgacgggtgcatcacaaggttggcaaacgcgccgtcatttgtaagtaaaagcagcccctcgctattgcggtcgagacgccccaccggatagacgtgcgcgggcgcatcctttacaagatcagtcacgcaccgccgtccaagctcatccgatgtggttgtaacaaagccgcgcggcttatggagcatgatatacacgttctgtttctttttgcgaagctgcacgcgcacgccgtcgatcgcgatcacgtcgcgcgccgggtcgaccgggttgcctggctgggcgggatggccgttgaccgtaacgcgtccctgcgcgatcgcctcctcggccttgcggcgcgacataactccattttcagaaagcaccttttggatgcggataccgtttacttttgccatgatgtcctccgttttcactcattccaatccgccgcccgtcatccgccaaacaggcgtgtgaataacggcgtttttccttttaccgccgcgacatcatctgccgccgtcagcgtcacatccgcaacaggctggccgccgacagaaaacagcgcgtgccccactacgtcgcccgcctgcaccggcgcgtataaaaacggctcggctgtgaccgtcacatccagccgctcgccgggcagcagcgcgaccggttccggctcctcaaatgtcacggcggcatacgtctgcgtcccgcccgtcacaggcaggtccgccgccgggatcatctcaccgggcgcggtctgcgtcagcgccccaaagtagtgttcataaagctttatatgctcgttccagtcgtcggggcagttgagcgtcacgacgatcaggcgcacgccgccgcgctgggcatacgacaccaggcaacggccagccgcatccgtaaacccggttttgacgcccgccgcatcgggatagagctttaaaagcctgttgtggttggaaagccaacggtcggccggcggattgccaaagcatacctttgcgcttttctgggagcagatttcggcaaagcgcggatttgagagcgcctcgcgcgtcagcagcgccatatcataggcgcttgagtaatgcgcgttgtcgtccagcccgctcggtgtgacaaaatgagaatcttccatccccagttcggcggcgcgctcgttcatcatccgcgcaaacgcctccttgctgcccgcgatgcgcacagcggccgcgttggcagcgtcgttgcccgacggcagcatcatcccataggcgagcgccgaaagcgtcacacggtcgccgacgcgcagccccatcgacgacccttcgacacggattgcatccgggtccacggtgaaccattcgtcctggccgtcctgctccagcgtcagcagcgtgctcatgatctttgtcgtcgaagccatcggcagacgcgcgttggcgtttttagcaaacagcacgcgcccggtcgcggcgtcgagtacgacggccgctttggcttttgtgtcaagaccaagcgtgtcgggaatcgactgcgcgaccgccggcgcggcgtcgagggcgcgcacatctgtcaggcgcacgcatataaacagcgccgcgaatgccgccagcaaaaggatcgcccgtttcagcatcacatcacccgcacctggaacctgccgccccacccgcagcggatgtttcaaacagcttccgaatttcgatacaggtcattttatgccgcgcgcgcgcacgaaattaccccttgctttccccgccgtccgcttcgatatgcgcacggcgctcttttttatcccgtttggcaaacagctcggcgaacttatcgaccatctccggcgccatggtgacgatgcggtcggcggtcgtcttgctgtcgttcatctgcaaaagctccacatgcccgtccttgatgacaaggaacgcgatcggctgcaccgaaacgccgccgccggcgccgccgccgaactggccggcctgcttgatggtcgggatatccgaaccgccggaggcgaagccgaagctcaccttggaaaccgggatgatcacggtcccgtcgggtgtggtgatcgcctcgccgacaacggtgtccgcgtcgacgagcgtgcgcaggttttgaagcgagctgtccatcagttcgctgattggatgcttttcattgctcatggaaagaacctccttttacagttcaccggccgcgcgcgcctgtcccggcctttggctgggacgcctgttcgcgccgtgttttcactttttcacggacggcctgcctttttacagtcttgacaagaaacgccgcgccaatccgcacggcggcggcggcggcgacaatcggcagcagccggccgcgcgcctcaaactgccaggaaccctcctgcgccataaaattcggcgtgatgaggatatccggctttttcaggttgaacagcccgcgcgccgccgtatacgccgtatagataagcgcgttcatatggccgaaggtaatcgcggtctgggccgcgtcgtcctccgcgacgacgacgcgcaggcgcacacggtagacgcgcacatgccgcaaaagcatcttcgcgccgccgccgagcgacgcgacgaagtccattgccgcaccaatgatcgccgcgaaatcccgcttctccttctttgcgggcgcggcaggcacctgctccttttgcttcttttgttttttcttcgcacgcgaccgcttcttttgcttcttccccaatagctgccgccggtaaaacaaccagcgcacatacgcctcgcccggggcgtccgagctaaaacgcgccgacccgacgatcgggatgcacaatagcagcagcaaaagcgccagaatcgccaaaagcacaaatccgaccaccgccattgcggtccctcccatccgttataccggcccggtttcctccagttcgccgaatgcgacctgaccctcgagcacatcgtccggcagcgcgtcctcatcggtggacggaagcgccggcagcttgtcgaggctttccaggccgaagcagcgcagaaaatccggcgtcgtgcggtaggcaatcggccgtccgggcagatcgagccgacccgcctcctcgatcagcgacttttcgatcagggaattgacgacgccggagctgtcgacgccgcgcacctgttcaataaacgcgcgcgtcactggctggttgtaggcgatgacagccagcacctccagcgctgcctgcgaaagcggcgcgctgcggcgcaattccagcgccgcgcggataaccgccgcatagtcggacgacgtgcacagctggagtcggtcgcccaggcgcagcacctcgaacggcatcccagcgtcggcgagcgcgtcgcgcagatgcggcacatagcgcaggaccgtttcctcgtccgcgccgatagcctgcgccacgcgcgatacctcgaccgcctcgccgcccgcaaacagaatggcgagtatttgtttctgcggcaaatcgatcatgtcggtgcctcctgttgctgccttgcccggccgccgcgctcaaacgaaacctggccgccgtcgaccgtgatgcggcgcgccttgacaagctccagcaccgccagaaacgtagcgacaagctcgctgcggtccgtgctggtcaaaaacaggctctcatacggcgcgctgcctgtccggtaaagcccgcgcaggatatgcagaatccggctgccgaccgatacaacgcggcgcgccacaattcctgaaaaggcgcgcaccggcggcggcagccgccgagcgccgcgcccggccgcatcgcggtacgcgtcatagaggatctgaggggaatgcgtcagcctgtacgaatggtcagccggcagcttcatcggctgccgcgcgaaattcagatataaccggctgagcgcgccaagctgcgcagccacccgctgacagacctggtactccaaaagctgtccctgcaattcggccttgagcttgacgccctcctcctcgtggcgcggcagcagcatcgctgttttgatatatacaagccgggcggccatctccagaaattcgctggcgatttccaggtcgtcctgccccatcgcgtcaatataggccagatactgctcgagcaacgccgaaatctcaatatcgcagatatcgagcttatgcttttgaatcagatacaaaagcagatcgagcgggccttcaaattcgcccgtcttaaactgaggcttttccatgctcacaggatcatccccgcgatcacattaacaaagccggtcagaaaattcagccccttaaacagcaggttgctcaggaacatcagcggtacattgagcgcgccgctcacgacgagtactagcagaacgatgtagatgacctgctggtactggcgcaccttgtactcccatttggccggtacaaaaaaggtgaggatggaaaagccgtcgagcggcggcaccggcagaaggttaaacaccgcgagagatacattgatagacgccattgtgatgaaaacccattccaaaatcgccagcgccccgcctgtattcgtcaccaggataacaaccatcaaaattttggcggccagcagcgaaagcagcgccaggatcacattggcagccggaccggccagcgacgtgagcgccatgcccgcgcgcatggaaatgcggcggtcaaagcgccgcggatcgaccggcacaggcttggcccacccgaaccgctgcgtcaaaatcagcatcagcgcgccgattgggtcgagatggcgcaggggattcagatcaagccttccctggcgcgcggctgtgtcgtctccaagcttatacgccatccaggcatgggcaaattcatgcgccggcagcgatgtaaccagcacgatcaatgtcacaaaaaaagtctgcatatcaaaaattcccatatccgcgcctttccgggagaggatgtaccccgctccccatccttcataatggtaatgatcatggattattataccgattcccgacgtaaaatacaagcggattcgcccgaaatcagcgcgccgtgctgtcaaaatgaaaattttgcaaaaaagcccttgcattcatccggcaaatctgatagaataccactgttgactttaaaaacagaatggaaaagatagaggaggtgcagaacatggcaaaatgcgatatctgcggtaaaggcgtaacgttcggaatcagggtttctcactcgcacaggcgctccaacagggcgtggaagcccaacgtacagcgcgtcaaggcgcttgtagacgggaccccccgccacatctatgcctgcacccgctgcctgcgttccgataaggttcagcgcgcgctgtaagccaactgcaatttgagaggacgccgcaaagcggcgtcctttttgtatccgcggcgcacttcctgcatttgcgacagcatggcgtgctatgatatttctggctgtttggccgcccttgttttcagggtaaggccctgacggctgataaaaaaagaggtaagaggtaattggcatgcgaaaagcattgatcaccggagcaagctccggtcttgggcgtgatctggcgcgggttctcagcggacgcggctacgatctgattctcgtcgcgcgccgccgcgaccggctcgaggcgctcgcgcgcacgctgccgactaaggcgcacatcatctgcgcggacctgtcagacgccggccgctgcaaagctctgtacgatgaaacgcgcagcgaacgcatcgacctgcttatcaacaacgccgggttcggccagttcggcgccttctgcgaaacgcagctcgatacggagctgcggatgatcgatacaaacatccgcgccgtgcatatactgaccaaactgttcctgcgcgatttgatcgcacgggacagcggttatattctcaatgtggcctcgatggccggttttatgccgggtcccggcatggcctgctactacgcgacaaaagcgtatgtcctgcgcctgacgcagtcgattagcgaggagctgcgccgccgcaagagtgccgtctatatcggcgcgctctgtcccggtccagtcgacacggagtttagcgcaacggccgatgtgcattttcgcatgccgtctctgccgagcgtcgaggtcgcatcctatgcggtcgatcagatgttccgccgcaagcggctgatcatccccggcaagccgatgaaaatcatgaagttcgctgctcgcctcgctccggaatcgctgcttgcgcgtgcctgcgggttcgtaaaccactcccggcatttttgaaaaaagcctcagcaaaaaacttcataccttttttgaaaaaaggtatgccaaaaaactttccggcctttttgaaaaaggcctcggcgaaaaactttagtcggctgcgccgcgaacagtggggcgggcgctgcgctgatacaggctgcgccgccaacaatggagcgggcgctgtgtttatacaggctgcacctgccccagggttgggtccatgggataggggcggcccgtctctgtcccgtgaggcgcgaaaaggggcgctgccgtatcctcacaaaataaaacatccgccgcaggttagggcttgtttgaaaatagaggaattgccggatttttcgcagacagcaggagaatacaaggcaaaaaacacaggaatcctttagttttacgctgataaggaagtattcacaacaacttatcactaacgctgacagacagggtgcaaacagagagttaatcactttcaatagtggttggctctctgtttttctatcttcactttgttacgcaatagaacgtcatttttgagggtagaagtataaaactatcatctgagcatttttcacgttctgcaagccacataaatcaagcattttttaccctctactgcgtaacatacctatcccaaaatcagcagttttataaagcaggtggattagacagttttgaataccgcataacttccggtgttggattatccgatattggattttccgacatcggtttatccgacattggaaaatccaacgcaattaaataaagatataaataactaaagaaataccaaatacggatttaatcaaatacccattcccttcctatcctttccctaatccctctcctttgggggcaaagcggcagagccgccggaatggaaaggaatggaacggaaacggcaatataaaaatatcgtttgttatgttacgcagtagaacctcatttttaggggttggagtataaaacccttacccctgcccttatcttcgctgtaatgccgcttaaatcaagcgagaagcacattctatcgcataacattccatactggatagagagcgtaagcggtttatccgattgcgcgctcttggctgctcaacagcaaagacagggaaagccgtcaaggacacgcaagtgtgcattttatccttgacggctttttctaactttgctactacctgtcaaaacggaattgtaggatagccttgataagctgtgctttcagacggtcttgaatatcgtcgttaatatgcccgcgataggtagacagatatttaatccgcgctgtgtaatgccgcagtaccgcgtctatggcttccggctcgccggcaacagctttctcaatggtttcaaagggtatcagtttcttattcctcatgttcagtttcctccagttcttttcttaactgcttcaatgccgccagtttccagtagttgactgtacttctgcttcttccgtactcattcccgatttttctttcgctgtaacctagaaagaaattcatcagcagaacagtgcgcctttgttctgacagattagctaatgcgtcggctaaccgtttacttgtaacgacaacttctttcccttgcacaacaaaaacagtcggcttttcataaacatactgctcaaaatagttgtcggttgcaaacggttcaaaagacgtttccgacatcagatagtcaagtgatacttcatgcttctgtttccgtcccaaatcgcggtacgcgctgattgccgcattgcggagaacgattttacagaacgtggcaaaggcatattcgatatgctccatgaattgttcagaatacttcatcataactcaccccctttcttcccagtagggggctattacaacaaacgcccatgcaggcataaaattgcataggcgtttggtaatatgagttatttaagtgactgtaatgatttgtgtgttcatctttatggtcgcaaaattccgttatatggaataggctttttttaacaatgaaataaggttataactgcgaaaaagggacatagcgatacctccttgataccgccgtatccttaaaaaagggcgactttaatacaccccccgtattctcatttttagaaaagaaaacggcggctttgattatatgatttcaaagccgccataaggtaaaccggcagcggctttcccctaaaaatgcttacttctttagttggtaaaagtcataaaatgcagcgtgtttagcaataagcgtttcaaatgtaccatgttcaataatcttcccgtctgccataaagataatctcgtcgtagagttcaagaatatctttgctcatattgtgcgtaatagtaagtaaagttaaatcagatatttccaacaacctactttcaatgtcatacgcagtctgcatatcaatagcagatgtaccctcgtctaaaattaacagcggctttttacgaattaaagctcttgccaccgcaattcgttgtttttgcccgccggaaaggttattaccgttttccccaacatgatattcaagtccgtttggtacttgctcaatgaaatgcaataagccactatcagacagtacagattgtagttcttctttgctgtaatcttcgtgtaaacaaatattgtctaaaatgctttcgtcaaacatatagacgttctgatgaatgaccgacgacaaggcggttattttatcaatatccacaatggaaagattatcttcatcatacagaacattgcctttgtaatcagaataatatccggcaatcagtttgataagcgtagattttccgcagccacttttaccaacaaaggcatattttttcccttttttaatggataatgaaataccgtttatgacttcattttctttatcataggaaaaatgcaaatcctccacacaaatcatctcattgaaagtagggggtttttttgtatttgcgtcttgcttccggtaatctgaaaattcatttagcttctgtgcaatcggctttatactcttgattttaggaatattactaaaaatgattaaaagcggatttgcaagattactgctaacctgcaccatgcctaataaggctcctgcgctgatacgtccgataataatgaaatatgccgaaagaaaaacaacaacaacttgaacaagaagcgcaagaaccatagaaaccgcttcatttgcagcaatcgttttgtcaactgaatattttgcttttatcgtgtcctcattacttgtttcaaatcgtgaaaggacatattttttcattcggtacgacttgataatttcaaagccggataacaggtcttttacatgatttgtaaaagaggatagcatatcagaatatttgtcctgtcgtttagagagcagtcctccgaacaaactgggtacgataaacataatggcgattgcaataattacgcataccgtaacgataatgtcgaagtaaatcattacagcaagggacgctatgaaaataatcgtgtattgaatgacttgcaggagaggaagtaaaaaattgtcctcaatcatttttacatcattcgtaattgcagataaataatctgcggtattgtttttagagtaatcctcaatcgtgtgtttctcaattcccataaaggttttagaacggacagctttcataatcttgcagacaaattttttgctgaacaaagattgtaggtacataaatactcccataagcgcaaagtaggctaaagaaaagagtaatattctgatgaaaccgtccatatcgcccatatctacaatgtccataacctgttgcaacaagatagcgataaacacataggatagagaactgatagcagtaaataatacggtaaggaaaagcagaaatttgtattgttttaagtatcgtatcatatagcggtgtcctcctattttctgttgaatatcaaatcacaaacaagccctgtcgcacccaaagcaaacagacaagtagctgttgatttatagcctttttcagataaatgtgcagcacctatcatcagtccgatttctgccgcagcagataccgattttgatacaatgcggaatgaacgctttttccacgctttatttgcggcaacttcaatcttgtttgcagcgatttcgattttttggtctaagttagacataataatctcctttcatacgttaagacggtatgtataagtccaaaaaaataataccttatgaatgaatgtattgggttgaaaataaaactgcctttctcaaggcaattttatttatttgcctacgtttagatgttcaagatagttttgcactataccaaaaatttcatcatcaataattggaagtttcatactatccaacaggtatttgataaatgcaaactttgaaatcagttcttctggtgtagcgggatagacagagggaattaaccaaaagtttgtaagtaagggcaaaagttcggatagttcttttgcatactcggtctggatagaaccgtcctctatcccctcttgaataagctgtaaccaaagaggggcaatcaattttctatttgtgtcagccagttctgctaacaaacgggggtttttcaaaaggggaatactttgtttgccaagctctgtcctatcaatatcgacatggtttagcttaataacttctcgcattttctgtaaaccattcaagttcttctgcttctgaacggtaacaaacgggttattatcaaaaaagagtttttcccccaatgcgtcgataatttcctcttttgatttaaaatgatgataaattgctcccttagtcagtccaccaagctcatttacaatatcttgaatagttgtattgtcatatcccttttccatgaataaccgctgtgatacttctaatattttctcaacagttacttcgggatatttatttcttgccataaaaaaaccacctccaaccgttattcattcgttcggtatgtatttagtataatcttaattctcaattttgtcaatatacattccaatggtatttattctacgttgtaaaatttaatatgctactgcaaaaaaagaatagcaaaatatattttcaaaaaataattgaagcgtcgcagattgcggcgtttttcttttgcatatctttggcatttccggcgcgtcctccgtagtaggaagtaagaaaaactttttgaaaaatttttctcaaaacttcggcaaaatcgctctgtccggtgttgtaggtagtgagaggaaaatcagagggtttgggaaacttcccaacaagcaacatgcaacgcattttcggaaaagggtactcttttcctatgattgtttcctattaggaacgctgtaaatacaaggcttttcggagcctacgaaccacaaaaaataatatttgatctatcacattacacaaaaagccgtccggcgttaaaatcgggcggcttttttgcgtggatagaccggaaggaggcggaaaaataattacagaaatttaacccgcaaaattgtgcaactttcacgaaaaggaggatagtgaatggcagatgaaaaattgaacacaggctccggtgaggagaagctcccggaggctcccgctcctgttgcggctgacgagccccaggctccggctcccgaacagactgccgctcccacaccccagcaggaggggcctgcccagcccgagcccggtgatgtggtggtgtcctttgacaaaatcaatgagctgatgaatgaaaagcggcagacagcccgggccgaggtagaaaaagaggaggcggcaaaagagccggaggagaaaacgcaggaggaacctcccgccgctggggatgacgaaccgaaaaaggcccgtcggggccgtcctccaaaagaggaaaaagcggagcctactgtcaaggaggcggcgaagccccgcaagggccgcccacccaaggcggataaggcggcccccggcgaggccacgccgactaagcgagacaaattgtcccgaagtgggaaaaaggctgcggaggttaaagctgccccggaacccgaaaaggccccacccgaaaatgcggcttcggtcccggaacaggctccacctgagccagccgctccgccccgtcctgtggaggaaggaaagctggtctatctgaaactttccgaaatgcatccgttccacacattccgcccccacccgtttaaggtgcgggacgacgccaaaatgcaggaaacggtagcgtccatcaaggcaaacggcgtaatggttcccggtcttgcccgcccggaaaaggatggcaacggttatgagatcgtggcgggccatcgccgccatcatggttgtgagctggccgggctggaggaaatgccctttatcgtccgggaaatgactgaccacgaggcggtacaggccatgaaggacagcaacaagcagagggatcagacgctccccagcgaactggccgccctgttggagctggaagtggaggacatcaagcaccagggcgggcggctgaaaaatgtggccgagggcgatattggaaaacgctccgttgagatcgtgggcgaggcgcacgacatgaactataaaaaggtcatgcgttatctgcggctgaactcccttgtgccggaactgctggacaaggtggacgataaaaaaatgggctttatgcccgctgtggagatttcctatatccgccccaaaaaccagcggctgatcgctgtttccattgacggagaacaggcgtccccctctctggcccaggcgaaaaagctccgggagctggacaaggacgggaaactcaatggtgatgtcattgatggcatcttatcagaaaagaaaaaggaggatcgaggcgtgattatttctaccgctgaactggaaaagtattttggcaaggaggccactcccgccaaaatgaaggagcagatcatgactttgctggacgagtggaaagagaaacagccgcccgagctggcaaaggctccgaaaaagatggagcaggacaagtaaccacttcgagacattttgtcccgagggccctgccctccgcatcatggctctggtggtatatatcccccgtcgccgcctgttttttcgtacagccgggagcgggctgtcaagggtgcatcgcaccgccgttttacggcggcctgcccttgacggtctgccccggctgtgctatttccccagcaagcggcgggggtatatcctccagagccgccccctttcccatgattgggaaagggcggggggattgggctgaactttcttattaaaatatcggaggtattgactatgaagcgtccccttgcatacattaccgccgcatggcttggcggcgacagtgaaaacgcagaacaggccgcccgctactgccgggcggtttatgaggcaggcttttccccgatctgcccgcccctttatctgcccctgtttctcaatgacgcagtacccgaggagcataaaagcggcatcgacatgggccgtgacctgctccgccgctcccatgtgctggtggtctgcggccacaccatgaccgaggccatgaaaaatgatattgccgtggcccagcggctgggaattaccgccaccacccttgagggcatcctgaccgtcaagggacagggcaaacgctgatggagtctgtttttgaggctttcatttcaaatcctgccctttacagtgcggggcatctggtgggggaaacgctgcatttccccaccaacacggaggaggtgcagtccctcttaaagcggatcggcgtggacggggtgcgctgccaggaatactttattatctcctttgacagcgacattctcggcctttatgactatctgggcgagtatgaaaacattgacgagcttaaccatctggcccatctgctgaaggaactctccacatcagaacgggaaacgctggaagcggttatggacagcggccagcattgtggctcggtgcaggacttgatcaacctcacgcagaatttagactgctatgactttcatcccggcgtggatgatgaggaaatgctgggccgcctgtatgtggaggatatggaaagtctcgaagtgccggataatataaaaccctactttgactttgaagcatacgggcgggacatttccatcaacgaaaacggacattttgcaccgggcggctatgtgacgaaggtaagtgacgatttccgggaggtctaccacggcccccaggacatccccgctgaacacagggtttttgcttacccccagctttcgatccgggagcagatggccgcttatcaagaaattattgacggttcctcaaaggaggggttccggcggctggctgaaaaacaccatgaggaacggtaacgggacttcgagacaatttgtcccaaggcgaaaggaggcggtgtaactgattgatgaagaaatttcccggagctccatagcgatttctgtccgggccagcaagctgacagcccgggggctggcctatgtactccgggcggcgggccgccagatcgccaaacggcataagaaagcccaaaggccctacggcaggcagagcgtgaaaaagctcatggcccacggcgaaagtgtgaacagcatcgaggtggaggctccgaagctctttgaccgtatggcccgccgtttcaatgtggactatgccttttacaaaaccgggccggacaaatacctgctgtttttcaaggcgggacaggcagatgccatcaccgcctgttttgaaagctattcccggaaactgcttggaaagtcaaaatccagccgcatcccgattagggaacagctcaaacaagcggcggaacagctcgcccaagaaaagcccaaaacgaaagagcggacaaaggaggtggttcgtgaagaacgataaaatcaagaaatacctcattcccaacattccctacctgttcattttgtgggcctgtctgaaattggggacggcctaccgtctggcggcgggggcggaattcgcttacaagctccttgggctgggccagaccatcggcccggcctttgccgactttgcaccggggctcaacccctttgactggctcatcggcattgtgggggctgtgggcttccgcctgctgatctatgtgaaaagcaggaacgcaaagaaattccggcgggatgaggagtacggatcagcccgttggggatctgaaaaagatatacgcccttttgtcgatcccaagtttgaaaacaacatcattctgaccgggacggagtttttaaccatgaatacccggcccaaaaatccggccaacgcccgcaacctcaatgcctgtgtgatcggttcgtccggctccggcaaaacccggttctggcttaccccgcagattttgcaggccagcgcagacaaaaacggcggctgcagctatgtgtgtgtcgatcccaaaggaggcgttctcgggcaggtggggcacttcctgcaaaagcgtgggtatcggatcaaggtattcaattccattgatttcacaaaatccatgcactataacccgctggcgtacatccgcaacgaggccgacatcctaaagtttgtggacgctctcatttccaacacaaagggcgaaggcaaggaaggcgatccattctggacaaaatcagagactttgctttattgcgccctcatcgcctatatcatttttgagggccccgccgaggatcggaacatgaacacattggttgacatgatttccgggatggaggtcaaggaggatgacgaggactttatgaacgccgtggactatatgtttgcgggcctggaaaaacgaaagcccgattgctttgcggtcaagcagtataaaaaatacaagctggccagcggtgttgtatgctctaaaagacttcttaatcaagcggttgggaagtctcttagaacacacaacctaaaaccgaagaaaggagcgcaagttatgagaaaaaatgagaaaatcacagctctgtacgaacgactgagccgtgatgactttggcaaagatgatgaccaacagcgtgagagcaattccatatccaatcaaaaggctatgttggaggagttcgccgcacggcagggctttacaaacattgtccatttcacggacgatggtatcagcggcacttgttttgaccgccccggatttttagccatgatgaaagaggttgaagccggaaatgtggaatacctctgtatcaaggacatgagccgcatgggtcgtgactatctgaaagtcggtcagattatggaaatcctgcgtcagcgtggcgttcgccttatcgccatcaatgacggcgtggacagtgccagaggggacgatgattttacccctttccgcaacattatgaacgagtattacgccagagacaccagccgtaaaatccgttccactttccagtccaaaggcaagtccggcaagcacctcacaggcacggtcatttacggctatctttggaacgaagccagagaccaatggttggttgaccccgaagccgccgaggtggtcaagcgcatctttgccatgacgattgacggctacggtccgtatcagatcgccagcaagctgaaagaagaaaaagtcctcattccgtccgcttaccttgcccggcacggcgagggcgtgaacaaaaataagaccttcaaagatgtgtacggctggggttcttccaccatctgcaacattcttgaaaagcgtgaatatctgggacacaccatcaacttcaagacccgaaagcacttcaaggacaagaaaagccattatgtcccggaggacgaatggacaattttcgagaatacccatgagcctatcattgaccagcagacctttgaccttgtgcagaaaatccgtgggaatgtcagacgctacccagacggctggggcgaagcagctcccctcacgggcttgctctattgcgccgattgcggtggcaagatgtatgtccaccgcaccaacaacggcaagcgtatttctcaatatacctgttcccaatacagcaaagtcccagttggaaagctctgcacgacacagcaccgtatcaatgaagatgtggtactgtcccttgtctctgaaatgctgaaagccattgccgagtatgcgaagcatgaccgagccgagtttgtccgtgtggtgcaggaagcgcagtccagccagcagacggcagaggtcaagaaacagcggacacgccttgccaccgcaaagcagagagtttccgagctggaagtcctgctctgcaaaatctatgaggacaacattttaggaaagctgtccgacagcagatacgccactctggacgctcaatacgaaaaggaacagtccgagcttaccgttgaaatctccgatctggaaaaggctatcaagagctacgagaagcacgaaaaggacgctgaccgttttatcgctctgattgacaagtatgagaacttcgacaagctgacgattgccatgctcaatgagtttattgagaaaatccttgtgcatgagcgtgaccgcaagggcagtattcagaccacacaggaggtcgagatttacttcaatttcgtgggtcgtttcgttccccctgcgtttggcgaagtggagcttaccccggaggaattagaggaaatccgcaagcgtgaggaacgcaaggacaggctccaccagaactacttgaagcggaaagccaatggtaaacagaaagagtatgaggagcgcacgaaagccaagaaaaaagcggagattgaagccagaaaacaggcaatccgcaccgaggatattgccagaggggtatttatcccggtgagcagtttgccgcagctgggaccgagaaagggagcgtgattttatgaaagagttgaaaccgagaatccatgagaacggtatggactatgtgttggtgggcgactactatgtgccggacttgaagctgccggaggaacgccgacctattgggcattggggacgcttgcgccagtcctatctgaaattgcaccgtcccatgctttacaacgagctaattttgtccggcaggctccacaccgtcgttgccgatctgaacgagcaggcggcagacaggctgaacttgattatccggcagatgatgaaagccgagggcgtgaccgaagccatgaaagcggaaaatcagatgttatgggtgcagtcaatgaactccatccgctgccgggcagaggaaatcatcaagacggaactaatctactgttgagagaggtaaagctatgattttggaagccatgtataatggggagttttatccctgcgagacagttgtacctacatcaccggaataccgaaaggcagtcatagcctgtgaaaagctcatggagcagttgtcccagcggctcagcaaagaggactatgagctggtgcaggaactccgggcgcagacagcaatcgcccaatgtgaagaaagtgaaagtcacttcaagtatggcttttccgctgggctgatgttcagcaggaagcccatgaacaagtgcagcagaagaaagaaaaatagatgaagaaagccgcctgagcagaaagaaactgttcgggcggtttcagcattcgccagtagatttattcacactcttgtgataaaatttactataataaagagcgtgatagcactaattttatggggggatgcttaatgaatagaattttgaaaaaatttttacagcggggtgtcgatttaagtcctgtgggagttgaactccgtgaggataatacaaattatttttgtaccccaaaaggggcatcggtttttggatgggcagggatagatggtatccacttctgtttcattcgtggatttggagagatggttttctctgtcagccccatgaatacttctcctgattatgttcatccagtagctgaaaattttaccgactttctgcggcttatactggcttgtggtgatgtggcggcagtggaacaagcgtggatgtggaacgaagcacagtttgaagcctttctcaatgaaaaccctacaacccaggaacaacagcaaactttatcggaaatttcagagaagatgaatttgttgcctatggaacaaccgtggacatatatcaaaaacctgcaatcttcctttgattacagtcagattaaatacacagaagattattacgataatgatatgacttcagaggcagaattggttgcccctgaatggaaggtctactttgatggagatttctggggacatcgaggtaaagaccgtgccggaaaagagatcaagctggataaacaattcgattgggctggatatcattgggtaattccggcagcttattcatgtagcaaaggacttgtcgttgatttttgtatgcgagttgattcagaaagcatccgtgacttcatgaaaaaatggaatctggactgggaaaatgactcatgtgaaaattttacccgtgagcaacagatgcagatggaatgggaaaacccactttgttttaacttcaaaccttgcttgaagttaaacgagaaaatattacagacaacccatggctgcgctgtgagctttaatccttgtctgccagatggcgttatcaatgagttggaagcaaaatgggcaatcgaccattatgggctggatagtacttatggctgggtcatatgcagagacgtatttccttggggaaccaagcatcaccctgaaatcaataaactttttcttacaatggagcagcaaccaggacaagttccaggctcacatttcaaagttcacgcacccggagattcatttatgttttcccatcctgttagcggaataacccatacactgaccgtgcaagaaatagaacagcagacagttcctcaaaatagttttggttctgatcgctggatttatccgacacattatattgccatgagttatacacttacccctgaaccgatggagaacatttcggtttttgactgtgatgaaggcgatagaccgatagaagttacaccagacgatcattcgttccgtccagttggcagtagttcctgttttgttgttggtgttattggtggtgcagatggtccgacagcagttatatatggaacaaattcacaagaaaaacttcatgctgcttgttctgctctgcactttgaaccggttggtgatgatgtcgagtggcgtatcgtgttcaatgttacgcagtttgacaaagaaacattcccaattatctaaaaatacccttagaactctaagggcgcacttctatactctctatcgagagtagtgcgtcctgcggagcttcattctctgtcagcagaagaaaactgcttgcctgcgaatgttgcgtcacttcgttccgtcaaggtggctacacccccttgcaccgctaaagcggctatcccctgtggacttgccgtccgcaaacggttttgacaaaccgttcgccgccagcaagtttgaaaatagtaaacgataatttaacaaaggagcgtgagcgtatgaaaaagattatgtttggaaacagtttaatgctattgggtattgctataatgatacttgcaggattaaaggtgatatatgtaggaacactgtgggtgtcgtttcttttaattatcgtgggttttgttatggctacgattggttttttcggtaaggatagcaaataaattatctaactgaatacaacaaccgaataccgaaaaatagaccgttgactggtcgcaatgtgcgaaaagttggcggtctttttttatacccattttcaaaaaaggaggtcaaccaaaatggcaaaacagaaaagccttgaacagcttcgagctgaaaaagagcaagtggaaaagcggcttgcacaggaacagcacaaactggagcgtttggagaacagaaagaaatatctggagaaaggcgaaaggcagaaacgtacccaccgcctttgcaatctgggcggcacgattgagagccttgccccggaggtcaaaaatctcacacgcaccgaaatgaccgagctgatggaacacatcttcggtctgccggaggtacagagagccgtccggcacatggagattacacacatcaaccaagcaaacagaggaaaggagctgaaagccaatggcactattccacttcacagtaacccaaacgaaacgcagtaaaggtcagtctgcgattgcttctgccgcctatcgttccggcgaaaagctgtacagcgagtattacggcgaatacagcgactacaccagaaagcgtggtgttatctgctctgacattctcctgccgccccatgcaccgaaagaatacgcagaccgtcagaccctatggaacgcagttgaaaaagccgagcgtggtaagaacgcccagcttgcatacagttttgaaatttccttgcagaatgaattttctcttgaagaaaacatcgctctggcaagggaatttttgtttcgggagtttgtcagccggggcatgaccgttgatgtgtcctttcacgaaaaggagtgtgaggacggcggcacacccaatccccattttcactttctctgccctattcgaccaatggagcaggacggcacatggggcataaaacaacggcgagaatatgtgctggacgaggagggcaaccgtattcgagacgcaaacggtaagtatgtgttcaatgccgttcccactaccgactggggcagtcccgaaacgctggaacattggcgtgaagcatgggcggagatgtgcaacgccaagtttgcggagaaaggtctggatgttcgtatcgaccaccgcagctatgaacggcagggcgtggatttacttcccaccattcacgagggagcaaccgtccgagcaatggagaagaaaggtatccgcaccgaaaagggcgagttcaaccgctggatcaaggcgaccaatgccgttatcaaggacatcagaaagaaaatctctctcctgttcgactggataacggagataaaagctgagcttgccaagccgcagacacccgaccttgtttctctgctgaacgattattacacccagcgaaaagccggggcatattcgcaaaaaggcaaaatcagcaatctgaaagagatgaacgagacctacaattatctccgggcaaacggcatttacacccttgaagatttggaaagcagattgcagagccaccgcaccaccgttgacggcttaaagacaacgatggacagccagaacgcccgaatgaaagcaatccgcagtcttaatgattactctgccacctacaagagcttaaagcctgtctatgacggcttgcagaaaatcaagtttgagaaatcgagagccaagtacaagacggaacacgctgataagctgaaaatgttctacaccgccagacgaaagctgaccgaggagttcccggacggcaaggtggatatgggaaagctatccaaagagtatgacacgctggaacaggagcatgagaccacctatgccgagtttaagaccgtcagagaggatttacagcggctttggaaagtaaagtcaaacattgatactgccgtccgatttaatcagcgtacagcggaacaaaagctccaaaatcaaccccaaatacgacacaaaaaggaggatatgacacgatgaattacacgcaggcacagattgaccgggcaaatgccgtcagtctggaagattttctccacacacagggagaaacacttatcaaaagcgggcgggagtaccgctggaaagagcatgacagtttgaccgtccggggaaacaaatggtttcgccacagtcagagcaaaggcggctatcccattgatttcgtcatggagttttacggaaagtcttttcccgaagctgtccaactgctgacaggtgaaagcggcgagggacagaccgaagccaccacagcaccgcccgcagagttccacttgcccctacacaaccgcacagtcgacagagcaattcaatatctttgtgaaagccgaggtctcaacaaatcgcttgttgagacttttcttctttccggggatatttacgaggacagcaaacggcacaatgttgtgtttgtcggcagagaccgaagcggcacaccgagatatgctcatgtgcgaggaacgcaggaaagtttcaggcaggacattgccggctctgataaatcttatccgttccgctatgagggaaacggcagtcagctctttgtctttgaagcacccatagaccttttatcctttatctgcctttatccgcaggactggcagacgagaagctaccttgccctgggcggtgtgtctggcaaggctcttgaccgttttctctctgaacgcaaggacatcttgaaagtgttcctctgccttgacagcgacaccgcaggaaatgaagcctgtacccgactggcacagactattcccggcgagaacgctgtcattcgtcttgtcccggcaagaaaagactggaacgatgttctccgtcagcaaggggatattcccaaccgcaaattcatagccgagacaatcacgctgcgagagctgccaaccgcccagcctgtccctatgctccgcatggctgatgtggagctgacgagcgtggattggctatggtttccgtatatcccattcggaaagctgaccatcatacagggcaaccccggcgagggcaaaacctactttgccatgcgtcttgcggcggcttgcaccaatcgaaagcctttgcccggtatggagacccttgagccgttcaacatcatctatcagaccgccgaggacggtctgggtgataccgtcaagccgagactgatagaagcggacgcagaccttgaacgagtgcttgtcattgatgacagggacataccgctgacccttgccgatgaacgcatagcaagagcaatccgggagaacaatgccaagctggttatcatagacccggtacaggcgtttttaggagcagatgtggatatgaacagagcaaatgaagtccgtcccatcttccgcagtctgggagatattgcacaggctaccgggtgtgctatcgttctgataggacacctcaacaaagccgcaggaacgcaaagcacctaccggggattaggctctatcgacattacggcggcagtccgcagtctgctgtttatcggcaaactgaaagacaatcccacaacgagggtgcttatccatgagaaaagctctcttgcaccacccggacagtcccttgctttttctctgggagacgagaaagggtttgaatggataggtgcttatgacattaccgccgatgaactgcttgccggaacggacacagccaagacggaaagcaagaccgcacaggcagaaatgctgatactggaactgctggcaaacggaaagaaaatgccaagtgcagagctggaaaaagcggtcaatgaccgagggatttcctcacgcaccatgcgaacggcgaaaagccgtatcggagacaggctcataaccgagaaagacggcacagcatgggtttgctatctccgaaactgacacaggaacaaggcaagcgtggcaaagacggcaaggtgtttatagataccttaatgttgccgccttgccttgttccctcatactgacaccgcccgatgatgaacagtcaccgggcatttttcatttacaggaggattttgaatgaacaataccgcaaccaacaccgccacttgcccgactgtcagaaagcagatcggcaagacaacctatatcgtgcgtgtgcatttcagccagaccgccaaggagacgatggaggacaaaatcaagcgtctgctgcgtgaggaagtccgcagaatgtgacttctttgtgaatttgatgaaaaagtccttgacttttcgtctctggcaaaacggcgaagtcgatccttatttcctgcggcgcaaggctggctccctttgacatcccccagcttcgggaggtcatggcctatgacgagctggagcttgaccgcatcggggatcggaaaacggcggtgttctttatcatctcggacactacgcaaacctataacttccttgtggctctggccttttcgcagatgttcaatctgctgtgcgagagggccgacaatgttcacggaggccgcctgccccaccatgtacgggtgctgtgggacgaggccgccaacacaggacaggttccccagcttgaaaagatcgtggctgttatccgttcccgtgagatcagcctgacgctgttctaccagcagttggcccagtgtaaggcgatttacgataaacacgccgaaaccattttgggaaatatggacagcgtgatattcctcggaggccgggaggccagcaccatcaaggaaatatccgagaactggctgggtaaggctaccatctccatgcagacggacagccgctcccgtggccaggcggaaagctacagtcaaaataaccagcggctgggccgggagctgatgacacccagcgaactggcgactatgcccggggataagtgcattttacagcttcggggcctgcccccgttctattccccgaaatacgatttgaaaaagcacccgaactaccgatatacggctgaagccgacaaaaagaaaaacgcctttgaccttgaccggctcattaaccgccgcaggcggcccgggccggacgagatgtgtgaggtgtatgccgtggctgtgccggacgatgggcccacaagcgaggacgaggacatcctcaattatgatgacatcgacgatccggacgcctttgcataaacagggctttgggacaaagtgtcccgaagtatgtaacctgccgccagaaatggcggcttttttcatggccgggaatcccccggagaaaaggaggctctatggaatttttcacttccgctattgatactttgcagacccttgttgtagctctcggcgctggtcttggcgtgtggggcgtggtcaatcttctggaaggctatggatcggacaacccaggttccaatgctcatgtacggtagagaagcacaaagcaaaacaaggatagccagccctgccactattccgaagtcaggggaacgcaatagaaaaattcatagctgtatgctatacttaattagcatttgaacatatcaagctgacacagcaatctctttacttgccgttaatgcgcgtctaccaatagtccgcacaaagcaagagtagcgtaaaggtataaaaatttcaaacttctttgtaacgaaattccgatttctccgtctaacctatgaagctgaagggggtgatgacaagtatggactatgaaaagctctataaagcctactatttacaggtatactcgtatactatttctcttgccaaaaatcgtgagatagcagaggaaatcacgcagaacacattctataaggctgtttctacaacatcacaattcaaaggtaagtcagatgaattgacatggctctgctccatagcaaaaaacctttaccatgatgaaatgcgaagccgtcagcgagtagctgatgtgagtgaaatcaatgacttgccatcaaatgaaaatgttgagaactcagttgcagattctgacatggcgttccgcatacacctcgttcttcaccgtttggaagaaccatacaaagaagtctttcagcttcgcgtattcggggaactatctttttcacaaatcgctgcaatttttggaaaaacagaatcatgggcgagagttacttatcatcgtgcaaagctaaaaattcaagaaaggatggatgaaaagcatgagtaaacaatgcgatattgttcgagatattcttccgctgtatgttgacggtgcttgcagcgaagcaagcgcagagatggtaaaagagcatttgaacgcctgtgctgactgtaacgcaatttatcagaaattgctttctcacacgaacgaagatgttcttcacgaagaaagcgaaagcgttattatgcgccatgaggcaaaagaaaagcagagaggcagaaaaaagataacgattgctgttctcgtttccatcgctctttgtatcattgcaatttttgcagctctctttctgttacctataaacattgcttatgagcctgtcaaaatcgacttcccatttgaggttgaagatgtcgaaagcgttgaaatgtaccactatgacggagtgcctgcatcagcagaaaagaaagtagttgttgctgaaaatgatataaagaccctgtatgataagttcaagggcttatccttaaaagacaaaacaactgaggaaactgccggagcagatgtgaccagctttagatttaacctctcagatggaacaagctacgatttgatttacgcctgctatggagttaaaaacggcgaattgaagtcagaagcaggcggttttaagtatttcacaagtgcggatattggctcttattggaacaatttgaatacggaacttgaagcaattcctatcaatgagagtgaattgccgtgagcagatagcaaacccagccgagcctgtcaacggtcaagatgaacggcgcaaatgcgccgccgttgacagccccgcccgtctttgctgttcggtaatcaagagggcgacagcacaagatgctgccgccctctgccattattcagaaagggggattttccatgaccgaacacgaaaagtatcaagaacatatccggcatacacacgatgccttttgcaagactgttattcgccacgctgccatagacgcagcccggagcatacggagccaccgcaagcgggaaatctcgcttgaatatctgatagaagaaaaacactatccattcagtaccacagataaatactttgcggagcaatccggcatgaccagctatccgcttttcgtctgtggtcagatggtgcttttggaaagtccagagcttgccgcagccctgtccgcactatcacagatggaacaggaaatcattttcttgtactacttccaacgattgacgcatagggagattggacggagatatggacgggctggcaacacaaccgggcggcgtattcagatgattttacggcggctacgggcagagttggagggcttgtcctatgaaccagctacttccctatgagacaatcgttaaggcaagcgagggcgacccggaagctgttgccgccgtcctatcccattatgcaggatatatccgctcttgtgcgaaaatggacggacagattaacacggatatgcaggagcatatcgtcaggcaactgatagaaagcctgttgaagttccgctttgaccgctaaacagaaaagttgtataattagagcctgacaaattaaacttcaatgagggtagagcaaatggaacagattatcaattatagagacatacccacagataaaaggattgacatattaaatgctcttgagcgaataggtttttttccggcatacggcggcgtgaaaacaatgcagcaaattatggaaaagtcagttccaggttcaggcccacaattctatttcgttttccgtgaaaatgagttgatagggtacaattttctcattggggacactaagaaatataaagcgttcccatggcttgctattagcaatatggatgagcagaagttgactgtttgtgaagaactgatgaaaatacaaattgccttttttgaagaactcggaatgcaaaagatagcagatcattgcattaggattatggaagattacagaaaaggaattggaaagcagaaagaaagcgattgcagataagttccatttgaaaaacggctgacaatttaataccgccgcccatcacagcggcagataagcagtaaatcttgaaaaggtttactgctttttttgcgcccattttcaaaaatctttggcaaaccacaccgccggattgttgtagggagcagacagggaaaacaaaaaaatttccgctgcgtttgccaaaacgcccccttttcaccgttgtagtggtgaacagcgggcagaacacgccgccgcaatcgctatattggtggagcaagccagtatatccgcaaaccagagccgccgaggaaagcggtagttttttagagcaagattctaccacggtgccaaaatccgcatatctgcggttttgccccctttggtaaatcttgttggggagtgccttccccaaaccctgctcatgcgccctgtcgggcgagaaaggaggtcaacgcttgaagaaaaaatataacacaccccaccgctgccatgtggtcaaaacccgcatgaccgaggaagaatacgccgactttaccgagcggctgaaacactatgacatgagccaatccgaatttatccggcaagccattacacgggcgaccattcgccccatcgttaccgtttccccggtcaatgatgaactgttgtccgccgttggcaggctgaccgccgaatacggaaaaatcggtggcaacctcaatcagattgcccgcgccctcaacgagtacggcacaccatacaacgccctgtccgttgaagtccgcgccgccatttctgaccttgctgccttgaagtttgaagtcctgcgaaaggtaggtgacgctgttggcaacattcaaacatatcagctctaaaaatgcggattatggcgcagccgagcagtacctcacctttgaacatgacgagtttaccatgaagcccacccttgatgaaaacgggcggctcatgctcagggaggactatcgaatagccacgctgaactgcggcgacgaggattttgccgttgcctgtatgcgctccaatctccgctatgggaagaaccagaagcgggaagatgtaaaaagccaccactacattatcagctttgacccacgggacgcggtggacaacggtttgaccgtagaccgggcgcaggcgttgggcgaggaattttgccggaagcagtttcccggacaccaagccattgtctgcacccacccggacggacacaaccacagcggcaatatccatgtgcatatcgttatcaactccctgcggatttacgaagtcccgcttctgccctacatggacagaccagccgacacacgggagggctgcaagcaccgctgcaccaacgccgctatggaatatttcaagagcgaagtcatggagatgtgccaccgggaggggctttaccaaatcgacctcttgaacggcagcaaggaacggataacggaacgggaatactgggcggcaaagaaagggcagcttgcccttgataaagagaacgccgccagagaagccgccggacagccagccaagcccacgaagtttgaaacagacaaggaaaaattgcggcaggccatacgtaccgcgctgtcctctgccacaagctatggcgagttcgccgccgttctcttgcaacagggcgtgactgtcaaggagagccgagggcggctatcctacctcacgccggacaggacaaagcccattaccgcccgcaagctgggagatgattttgaccgcgctgccgttcttgcccttttggaacagaacgcccacagagccgccgagcagaccgcaaccgtacccgaatacccccgcaacataagggagcgtttgcagggcaaaaaagctgtccaaaccaccccggaaaaggacggtattcagcgcatggttgaccgggcagcgaagcgagcggagggaaagggcgcgggctatgaccgctgggcggcagtccacaatctgaaacaaatggcggctaccgttgccgcctacgggcagtacggctattcgccggaggagctggacgcagcccttgtatccgccaatgcggatttacaggacagcaccgccaagctgaaagccctggacgctgctatccgggagaaaaaggaacttcagacacaggcgcttgcctatgccaagaccaagcctgcccgtgacggtttgaaagcgcagaaaacggaaaaagcccgcagcgcctaccgggaacggcacgaaagcgattttatcatagcggacgcagccacccgttattttcgggcgcatggcgtttccaagctgccaagccataaagccctgcaagcggaaatcgagcagcttaccgccgaaaagaacgcccattacaacgaataccgggagaaaaaagcccgtgtcaaggagctgcataccgtgaaaagcaatctttctcaaatcctgcaaggcgagaaagacagagagaaaaagcacgaacatgagcgttaaaaaccgccccgaaacgataccaaaacggggatatgccctgcaccctatccgcaatactgcccacctttgaaacggggcgcacagcgcaggaaatccccgaaaatgacaccgagaaaccacatttttaccgacctatccgcttataccagcggaaacggcagaaaggagcgagaaatgccacgcatgagcaaaaagcggcggttggaatggagctttttcctcaaccaccgaaaccgtattacctacaatgacctttgccggagctgcacacgcggctgcaagcagagcttccgggcgattatcgtcctctgcccccggtatttctctaagagatggaaacacagggaggacaccgccaatggcagataaccgcaaatattactacctcaaactgaaagaaaacttcttcgacagcgattccattgtgctgttggaggacatgaaagacgggattttgtattccaatatcctcttgaagctgtacttaaaatcgctgaaaaatggcggcagattgcagcttgacgagcatatcccctataccgcccagatgatagccacgctgacccgtcaccaaatcgggacggtggaacgggcattagccatcttccagcagttagggcttgtggagcagcttgactgcgggctgctttatatgaccgacatcgagctgatgatcggtcaatcctctaccgaagcggaacggaaacgcgccgcaaggcttgaaaataaggcacttttgccgccgcggacaaatggcggacatttgtccgacattcgtccaccagagatagagataaagaaagagatagatatagagttagaaaaagagggagagttaaagggacaagccctcgcccgcagctatggcagatatgagaatgtatttctgactgatacggagctttccgaactgcaagcggagctgcccgaaaaatgggcgtactacattgatcggctttccggctatatcgcgtccacgggcaagaaatataaaaaccacgccgccactatccgcagatgggcggcagacgataccgcaaaggctgccccgaaacagggcatacccgaatatacctgcaaggagggcgagagcttatgagtaatctgtttacagaacgagttttgaatatggcggctgttaccccacagccggaggactacacgggcgaggacggactgctttactgcggcaagtgtcacactccgaaagaagcctacttcccggaaaagcaagccgccctgtttgggcgtgaccgccacccggcagaatgtgactgccagaaagcccagcgtttggagcgtgaagccgccgaacagcgcagaaagcaccttgacaccgtggaggacttgaaacgccggggatttaccaatcctaccatgcaggaatggactttcgccaacgacaacgggaaatgcccgcaaatggagattgcacacttctatgtggagcattgggaaatcatgcgcgaggaaaatatcggctatctgctatggggcaaggtcggcacaggaaaaagctattttgccgggtgtatcgctaatgccctcatggagcaggaagtcgctgtccgcatgacgaacttctctgcgattttgaatgacctgaccgccagctttgaggggcgcaacgagtatatcgagcgtctttgccgttttcctctgcttatcattgatgattttggaatggagcgcggcacagagtacggtttagaacaggtctacaatgtgattgacagccgctaccgcagccgcaagcccttaatcgttactaccaatctgacattggacagcctgcaaaatccgctggacaccgcccatgcccggatttatgaccgccttttggaaatgtgcgcccctatcctctttacgggagagaacttccgccgtgaaacggcgcaggccaagctgaacagactaaaagaattgatgaaatgaaaggagttgcctatggcagagaacaagcagaacaccaccccggaacgccgcccggactgcgtgacagagatccgcatgggcaacaccgtccttgtcgtttccggctttttcaaaaaagataccaccgacaccgcagccgataagatgatgaaagtgctggaggcggaagccgccgcaggacacaaagcccagctttcgccctaacgctacaagccgcacagtaaaaaatcgtcattttgacaggcggtaaagaagcagaagccactatacagacagccgccccatgtggtataatcgaaatacggaatagtggggctggctgtcggaaacggaggattttatgttaagacagaccacccagaaaatcactgccctttatccaagactatcccatgaggacgagctgcaaggcgaaagcaattccatttccaaccagaagcgtatccttgaaacctacgcaaagcagaacggcttttccaatctgcgctggtacacggacgatggctattctggtgcgaacttccaaagaccgggctttcaatccatgcttgcggacattgaagccgggaaagtggctaccgttatcgtaaaggatatgtcacggttagggcgaaactacctgcaggtgggaatgtataccgagatgattttcccacaaaaaggagtccgctttatcgccatcaacgatggagtagacagcgcacagggcgacaatgattttgcccctctgcggaacattttcaacgaatggctggtgagagatacgagtaagaaaatcaaagctgtaaaacggtcaaaaggcatgagcggcaagcctgttacgagcaaacccgtgtacggctacctcatggacgaggacgaaaacttcatcattgacgaggaagccgcacccgtggtcaagcagatataccgtctgtgccttgccgggaacggtccgaccaagatagcccgtatgctgaccgagcaggaaatcccaacgccgggaacgctggaataccgcaggacgggcagcacacgccgctatcaccccggctatgagtgcaaatgggcgacaaataccgtggtgcatatccttgaaaaccgggagtacatgggctgtttggtgaacttcaagacggagaaaccgtcctacaagaccaagcacagcatagaaaatcccattgagaaacaggcaattttcgagaaccaccatgagcctatcatcgacacccagacatgggagcgtgtgcaggaattacgcaaacagcgcaagcgtccgaaccgctatgatgaagtgggcttgttctctggtatgctcttttgcgcggactgcggcagcgtcatgtatcagcagcgttaccagaccgataagcggaaacaggactgctatatctgcgggaactacaaaaagcgcacccatgactgcaccgcacattttatccgcacagaccttttgactgcgggcgttctctccaatctacggaaagtgacgagctatgcggcaaagcatgaagcccggtttatgaagctgctgatcgagcagaacgaggacggcggcaaacgccggaacgccgccaagaaaaaggaactggaagctgccgaaaagcgtatcggtgaactttccgctattttcaagcggctgtatgaggacagcgtaggcggtcgcatttctgacgagcgtttcacggagctttcggcagactatgaagccgaacagcaggaattgaaagagcgtgttgccagaatacaggcggagctttccaaagcacaggaagctaccgtaaacgcagaaaagtttatgaacattgtccgcaagcacatgaactttgaagaactgacccacaccctcttacgtgagtttgtagagaaaatcgttgtgcatgagtgcagctacgatgaaaacggcacacgcagacaggatattgagatttactattctttcgtcggcaaggtggacttgcccgaatgaccgcctgccctatccgataccaaagacaagtatcggataggaaaggcaaaattttttacacttctattacttctttatcacacataagcaaaaagccagggcatgaagcagttcatggctaattagttggaacaaaaaacgaaaggaaaagcacaatccagacggtatcagcggcagtctacaagaataaattgtgatttcacaagattggtgttataataagagaaaagttcctgccggggcagccgccccggtggtatggatagaaaggcaggaaaacaatatgcacatcagctataaaccactctggcacacactgttagagcgtgatatgagaaaagaggatttaaggcttgctgctggtatgacaacaaatatgattgccaacatgagcaaagagggaaagcacatcagcatggatacattagcccgtatctgcgaaacgctgaattgtgagattaccgatgtgattgagttagtaccagacgagcctgcttccacaggaggtaaggaacatgagcgaattgaaaccaagaataacggaaaacggaattgattatatccttgtcggagattactacatcccggacttgaaactgccggaggaacaccgccccatcggaaaatatggacggatgcaccgggaatatttaagagaagtccatccagccagattgaacacattgatactgaccggagaattgtggacatatcttgcagacctgaatggacaggcacagaatctgttagataccatcatggagcagatgaaagccgccgagggtgtaacagaggaattgaagcgtacccggcaaatggaatgggtgcagcgttccaataacattcacaaccgggcagaagaaattgttttgcatgagatgatttatttataacggtatggtagaatgattgtaacaaatttgaatttgtggaggaacttgtatgaaaaaaataattattgcaatggttgctatggcattattgattggttggcctggtgctggaatttgggctactgtttttcctaaaatattaggcggtggaatatcggagagttatctttaccctatctatgggggaattattctactgacaggtttagtggttggatgcacagtatatatttctgatgaaatcaaatctctgaaagaagaaatcagaaagggcaaagaagaaaaaggcatttaaatccgaatttgcaaaggaggcataaactatgaaagaatatcaacatctaataggtaaaattattattgcgactgcaattatagttgccgcaatcattatagcgggtgctatcgagggtgcaggagaaagtatacgtagtggtttgtttcagttaggggatgcactacgataaattccattttgccatttttaactgaataaccacagcacaaaccgctgctacatggaatccaacaaaccatgcaacagcggttttcctttaccgttttttcctctggttgataggcgttcccgttttctttgatttttggagaatccgaataagccagcgaaattcttcatctgacagatttttatagttgataccgagctgcttgcagtaaagcactgccagtttttccaaacggctgcccttgaaattttcgaccgcttccagattttctttcagttcattggcaacagtggtctggggcgcactctcactatcctttttatgggtttcccgaatatcccggataatcaggtttaggtcatccagaaccatgtggctgaaatattcatcatcactgatatgggcggcttgcagcactttcaaatgtgggtcatcttcgccagggcgataccgttctatgatttcatgtcggacagtatcgacaagggtgttgaggttttgaatctgcatggtggcaatcccatccacataaatctcaatgtccgcaagaaacttgataaagtccttatgggtggcaagttcgcagagcagacggttgttgatccgaccgcttttcagaagtgcaaccatttcatcgttcaaatgcagctccgtcagtggcgtgttgatctgctccctgttctctgtccggcacagcagataatcgacggaaaccccatagaagtctgccagcgtgataaggttgccatgattgatttccttaaaatcttctttttcataactgccaagggctgatttagaaatacccgttagttttgatagttcttccagatttaagcctttgtccttgcggagttcccaaaggcgttcctgtatgcttgttgctcctttcatgggcacacgctcctttccaacggtttcattgctgccgcttatctggattatatcacactttccgtaatcgtggaaatttctgatttttacccttaattcctactttgtggacatacggcacagggcacaaaaatgttctatgatacaggtagttcatcgatggattattccaatcgaatgaccagcctgtgtgggatatgcttccccggcgatgtagcgccatgaattttggcagggatatggaggaaccctgaccaaaacgagcgtaccaaagggagcgatacgccgctgtgagattcaggggaggaacgacaccggggagaactggcgaactgacaccgaaatgataccgaaacacaacaatctgatagggggacagtctaccctatcgctgatacttcgggagattttaagcggctctatggctgtaattttaccgaaaatcgccccgaaaccatacactaaaacgggaggaagcgcaatatgccgagaatgagcaaaaagaggaagtatgagctttccttttacctcaatgaccgggggcgtgtcacttacaacgaattatgccggaaatgccagcatgggtgcaagcagagcttccgggcggttgtgattgactgcccctgttatttatccaaacgagcaaagaaaaaggaggaacacacagaatgaattttgaatttatgacgatagacacaccattgccgccctgtatgccttttcccagagcgttgacaggatttccagtcagcagcaccgcaaaggtcatgtactgccggatgctggacgctatgctctccaaagggcaggaggacgagaacggaatcctctttgtctgcttccctgtcacagccattgccgcagtcctgtcccgcagctccatgacggtcaagcgttctctgaatgaactggaaactgccggacttatcatgcgggtgcgtcagggcattggagaaccaaaccggatttatgtgctgataccgggaaaggaggacgctgcccttgcctgatacctcaaagctggaaaaactcaatcgggagttggaaaaaagcgaaaagaaactgcggaaagccatcaatgatgaaaaggcattgcagcaccagttgaaacagcttacccgaaaggaacggacgcaccggctctgtacccgtggcggtatgctggaaagttttctgcaagagccggaacgcctgacagatgatgatgtcatgctgttgttgaaactcatttttcacagacaggacacgcaggaactattgaaaaaactgctggaacgggagatgccggaacccccttagtttactaagggcgcaattatacaccacccaaaggttggtgcattgcgttctccgaaggctcctcgccggagggctgtgattttccgcagtcatggtctgctccaaatcatacaggggacgctacgcttcccctgcgctggctgtcgccagctacccttttgtggacttgccgcccggaaacaccttgcgctgcaagctgttcccgtccagcaagttttatcagtcgagctatccttatctacggtaatttagtataataaggtcaaaaaacagaacgctatcattgtgcaaccgatatgcaactgataattgcttgatagttggtggtagcaacacggtaattcagatagaataaagccaacaaagaaaggaggtcatccaaatgttagtaaacatcattatgattgtagtcggaatagttttctcatgtatctttgtcggcttgcttatccttgttattcgtgcattgcttaaatatatccgtacagagaaatgaagccaacagcaacattaggaggtggtcaaatgaaagtaaccgtatttatgataatcgttggaataattttcttatgtatctttgttggtttgcttacccttattgttcgtgcattactcaaatatatccattcaaaagatgtacggcaggaaaaatccgtagtgaggaaatcgttgggtgaagcactcaaagtacacagaacacagtgcaaaatgacgcaggaatttgttgctgaaacgattggtgttagcaggcaggctgtttcaaaatgggaaaatggaacatccgacccttccacatcaaatctttttgcacttgcaaaactttacggtatttctgttgaagaattactaaaagaagttgaataatcttcatgcagatattttatttcatcatcgggccaccctgacccgaactttcaaaactgaataccagccgcccaccggcggcaccaccgagcaggaaatctgaaaaggtctcctgctttttttctgccccaaatgaggtggtaaaacgccaccccatccaccaattaccgaaaggagggacacgaaatgccctgtccacacaacgaaatctcgattgtgcagcgaagccaacagcagtctgcggttgccgccgctgcctaccagagcggcgaaaagctgttctgtggatacgatcaggaagtgaagcactacccggaaaagcgtggtatcgtccacaatgaaatcttgcttccggcaaatgccccacggtcgtatgcagaccgcaatactttatggaacgccgccgaagcggtggagaagcaatggaattcccagcttgcaaggcggtgggtgcttaccatccccagagagataccgcccgaccagtacgccgcccttgtccgggatttctgcaatcagcagtttgtttccaaaggaatgtgcgtggattttgccatccatgacaaaggggacggaaaccctcacgctcatgtcatgctgactatgcgggcaatggatgaacatgggaaatggcttcccaagagccgcaaggtttatgaccttgacgagaacggggaacggataaaacttccgtccggcagatggaaaagtcacaaggaagatacggttgactggaacgaccgcaagtattgtgaaatctggcggcatgaatgggagatcatccagaaccgctatctggaagccaacaaccgcccggagcgggtggatctccgttcttatgaaagacaggggcttgatattatccctaccgtccatgagggtgctgctgtccggcagatggaaaagcgagggattcagaccaacatcggaaatctgaaccgggaaatcaaagccgccaacagcctgatgaagtctatccggcagcttattaaaaatctcaaaggctggattatcgagcttagtgaaaaacgaaaagaactgcttgcggaaaaagctgcggaggaagcggtatttcttcccaatctgttgatgaagtacatggaggtacgaaaggcagaacggagcgactggacacgggcgggacaaaaccgtggaacttccaaagacttaaaggcagtcagcgaagccctgtcctatcttcagagaaagggactttccaccgtggaggatttggaaaactttatagaaacgtccgggaaatctgccgccgactaccgaaagcagatgaagccaaaggaaacccgcagcaacgtgattgacgctatccttgccgcccggacggactgtaaggaatgtaagcccgtttatgagaaataccagaagatatttttcaagaaaactaaggaaaaattcaagctggaacacccggaggttgcccggtttgagaaagccagtgcctaccttgccaagcacccggatgataaggacagcacgaaaaaggagcttttgcaggaacaggcgaagcttgtgggcgaaatcgcagacttgaaagtaccgttgaccgaggtgcaggaagatttgaagaagctgcgggacatccgctactgggtacggaaagccacacccggcacagaggaaagcaaagagccgcccaagaagcagcccctcaaagaagtcttgcaggataaggctgacgagaagaaagcacagaaaaacgccccggcgcagacgaaacacaaacaacaggatatggaactttaacaggcacttgccattttcagattgagaatgataagtgccttttcttttttacaaggaggaattgatttgaatgtatttgaagctgtgaagcagtccgttacgacaagacaggctgcggagcattacggaatccgggtaaacagaaacgggatggcttgctgcccgttccacaacgataagacccccagcatgaagctggacaagcgtttccactgcttcggatgtggtgcagatggggatgtgattgattttgtagctgccctgtacgggctggggaaaaaggaagccgccgcacagttggcgagtgacttcgggcttgcctatgaggactggaagccaccgggcagggcaaggaagcccaagccccggcagaaatccccggaagaacagttccgggaagcaaaggcacattgcttccgtgtccttgccgattatctacacctcttacgggtatggaaaaccgactatgccccgcactccccggaggaagcgtttcatccccggttcgtggaagccttgcagaagcaagcccatgtggaatatctgctggatgtgctgctgttcggggagacagaggaaaaagcggttttgattatggactacggaaaggatgtgatacagcttgaacagcgaatggcagagcttgcagccgcagacgcagcaagaactaaaaaacaccatgaacgccatgcagccgccccagagcgttgaggaagtaaaggcaactctggaaaccaccgagaaaggcggcgtccgccagagcatacggaactgcctgaccgtattccagcgtgaccctgtgcttgccggggcaatcgcctacaacatcctgaccgaccgcaaggacatcataaagcccatcggttttcacagagaaagcacagccctgaccgatacggacatgaagtatctgcttctctatctggaggaaacctacgggcttaccagtgagaaaaagattgaaaccgccatcgggattgtggcgaatgagaataagtaccaccccatccgggattttctgaacagccttgcatgggacgggactgagcgcatccgcttctgtctgcggcactttctgggagctgatgtggacgattacacctatgaagccttgaagctgttcatgctgggggcgattacaagggcatttaagcccggaagcaagtttgaaatcatgctgtgtctggtaggcggtcagggggctggcaaatccaccttcttccggctgctggcagtccgggacgagtggttttccgatgatttgcggaagctggacgatgataacgtgtaccgcaagctgcaaggtcactggataattgaaatgtcggaaatgatggcaaccgccaatgccaagagcattgaggaaatcaagtcctttctaagccgccagaaagaggtttacaaaattccctatgaaactcacccggcagaccgcccccgtcaatgcgtgttcggcggcacttccaacgcccttgactttctcccccttgaccgttccggcaaccgccgatttatcccggtcatggtgtacccggagcaagccgaggttcacattttggaggacgaagccgcttccagagcctatatcagccagatgtgggcggaagcaatggagatttaccgaagcggcatgttcaagctgtcattcagcccagccatgcagcggtatctcaaagaacaccagcgggattttatgccggaggacaccaaagccgggatgatacaggcttaccttgataagtacaccggggaaacggtctgctccaagcagctctacaaggaagccttaaaccacacctttgatgagccgaagcaatgggaaatccgggaaatcaacgagataatgaaccagtgcattaccgggtggaactacttttccaatccgaggatgtttgcggaatacggcagacaaaagggctgggagcgtgaaatcccggcaacggacaccgacaacccgcccgaaaaatctatggacggttttgtggaggtcacagagcagatggagcttccattctgaaaatgacagcccgttgccgacttcgttgctatcccgttgccgagccggttgccggggaaaatcccttatttccgggctttttccctctctgacaaccaaaacaacagaaaaataaaagaaaagtataaatagtaatcaacgccagattgagattgtttgcaaggtcttttgaagcccgttgccggacttcgttgccgaccgttctctgtctggctattttcatgtatggaggataactgcctatggcgaaaaataagaccaagattgaagtgacaaccgtatttgacggggaactggacgccaccgatgtgttcgtcagcctgatttcccagaaatacggcaaaacaaatacaaaagaatatcttgctaaaaagaaagatttgaagtataatgaagatgaggttcaacagagccagataccgtctggattgtgtgggtaaatggctatgatgaacgaaatggaatacagaacaatcggttcagcacttgccgggggctatcgtgcggcggtctattgcaggctgtcaaaggacgatgacctgcaaggcgaaagtgccagtatcgcaaaccagcgtgatatgctggaaaaatactgcgaaaagcagggatgggaggttgtggcagtctatcaggacgatggcttcacaggtcttaatatggagcgtcctgatttacagagaatgttgagagccattgagcgcaggcaaatcaaccttgtcatcacgaaagacctcagccgactggggcgtaactatttgcaaacagggcatttgattgaggactttttcccaagaaacggtgtccgctatatcgccatgaatgacggtatcgacaccctgcgggataacaacgacatcgccccgttcaagaatatcctgaacgagatgtacagcaaggatatttccaagaaagtccattcctcttatcttctgaaagcgcagaaaggacagtttaccgggtgtcttgccccgtttgggtatcggaaagacccggaggacaaaaaccatctgctcattgacgaggaaaccgccccgattgtgcggctgattttcggatatgccctaaacggtcatggtccgaactatatccgcagacggctggaggaagaaaaaatcccctgccccacatggtggaaccgggaacgggggcttcgcaatacccgcaccaaatgggaaaagaaagacccggaaaacgggcggtatatgtgggacttttccgttatcaaagaccttttgatgaatcccgtttacactggggcgattgcttcccagaaaaaggactaccgtttcaaaatcggcacgattggggaaaagaagccggaggactggattgtagtggaaggacagcatgaaccgctgattgaccgcatgagctttgacattgtgcagaacaagctgaaatcccgccagcgtccggggcagaccaatgaaatcagcctgtttgccggactgataaaatgcggcgagtgtgggaagtctctgacggtacgctacacaaacgcaaaacatccccagcagatttactcctgcaagacctacaatgcctttggaaagaaccactgcacccagcaccggattgattatgacaccctttacagtcatgtgctgcggaaaatccgggaatgtgccagagctgccctgatggacgggaaagcggttgctgaccgcctgaccaatacctgtgaagccgagcagcgggaacagcgggaagcaatggaacgctcccttacaagggacgaggaacggattgaggttctggacaaaatggtaatgcggctttatgaagatatgattgcagggcgtatcagtgagcagaacttcaacaccatgctggaaaagacacagaccgagcagacggaacttaaaacaaaagtgtccgagggcagaaagcggctgtccgatgaagtccagcttgccaatgacgcaaaacaatgggtggaagccattcaggaatatgccaacatcacagagttggacgcagccaccctcaaccgcttaatcaaagaaatcgtcgtgcatgagcgcattgacgaagataaaacaagacacatttctatcgaaattcattttaatctcaaacccatcccggaggtggaacaggtcactgcctgacctgtcccgccgggacggttctcttaaaaacaccatatagattttttgtacgccgccgcccgccatcgagcagagttttacacctatttggggataaaacagctcatggctggcggcggcatcatccttttgggaaccacgctgatccccctgctgtctggcttgttctaaggagggcttatggattttctcgccgattggctcacgaactggctgaaagagctgttgatcagcggcatcatggggaacctcgaagggctctttgataccgtcaatgccaaagtcggagagattgcggtacaggtagggactaccccggcggcatggaacgccggggttttctccctcatccgccagctttccgaaacggtgatccttccgattgccggattggtgctgacctttgttgccacctacgagctgatacagatgcttttggaaaagaacaatatgcacgagtttgatgtggcgaatatctacaagtgggtattcaaaaccgcttgtgccatcctcattctttccaacacctttgatattgtcatggcggtgttcgatgtgtcgcagagcgtgattgcggatgcggcggggctcatccaaggctccaccgacattacgccggatatgctggcggagctggaaaccacgctggagggcatggacttggggccgctccttggcctgtggctccagtcctctgtgatcgggctgaccatgcagattatggggatcatcattttcgttctggtgtacggaagaatgattgaaatatatttaatgaccagtttagcgcccctgcccgttgccacgctttccaaccgggagctgggcggtacagggcagaactacctaaaatccctgttcgccgtgggctttcaagggatgctcatactggtctgtgttgcgatctatgcggtgcttattcaaggcatcgccacaggcggcgatccgattggagcgatatggggaaccgtaggctatacggttcttctgtgcttcatgctgtttaagacaggcggcatcgcccagcgcatcttcggggcgcattaaacggacggacttcgggacaatttgtcccgaggccgggaaaggaggaaatgattttgagtaaggatgtcatattaaccccggaacagatcgccgccgaggagcggcgttggctgttcgatgcgccgattgcggaactggccgaggtaaaaggcgtgacggtggacgaggcggttaagctgcggacggacgcaattttgcaggaggccgctgttcccatcgaagtcacggttcgcccgattgagcctcagggcaagctcatcggctttgccagcgtcaactatggcggtgtagtgattgacgatttcaaggtggtggatggcaagaacgggattttccttggagctcccagcaaacccgatcccaccagcaggacgggctaccgctccacggtgcggatcaatgaccgggccacccaggagcggctcaatgcggcgggagcccaggcgtaccattcagcggtggaaaagctcatcgcccgggccgaggcagtccgccccaccccgatcaaggagcagatggcacaggccgcaagggaggccgggaaggaaaatgccgcccgaaccgctccggcaaagaagaaggaggcccgggatgacaggtgatgtgacctcgagacaaattgtcccgaagtctccagcctgcccggaggggctgtttttgatggacgggattgaagggctgcgctctttgccgaagcactcggttgatatgctccttaccgatccgccctatggcactacccggaacttttgggatgtgccgctcccgctcccggagctgtgggaggcggtcaagtgggctgtcaagccggatggcgcagtgctgtttttcgcacaatgcccctatgataaggtgctgggggcatccaacctctctatgctccgctatgaatgggtgtggtacaaaagcaggtgtactggctttctcaacgcaaggcgggctcccctaaagcggacggagaacattctggtgttttatcaaaaattgccctattacgatccgcagtttgaacagggcaagccctataagaaaatttcccggacgggggacaacagccccaactatggaaaattcctgcgttccagcagcggatcagaggacggcctgcgtttccccggaaacctgttgtccttttcttccgtacagcgtaccgtccaccctacgcaaaagcccgtggagctgtgcgagtatctcattaagacctacacccggcccggggaagtggtggcagacatctgcgctggctccggcacaaccgccgttgccgccctcaatatgggccgccgctttgtatgctttgaaaccgccccggccttttacgccccagctacggagcgcatccggctggctgatgaggcagtcaaagccgggcagaaaggagtatgattatcggaaactattctatcatttacgccgatcccccttggcagtaccagcgcagtaaggtacagggggcggcagaaaaccattatcccacaatggggattgacgagctttgtgcgctcccggtggctgatctggcggccccggacagcgcactttttttgtgggcgactttcccccagctcccggaggccctgcggctcatagaggcgtggggcttccgctataagtcggtggcctttgtgtggctcaaaaagaataaaaaggcagacagttggttttatggccttggcttctggacgaggggaaacgctgagatctgcctgctggctaccaggggccatcccaaacggcaggcggcaaatatccatcagtttatcatttccccgattgaagcccacagcaaaaagccggacgaggcccgggaaaagattgtggccctcatgggcgacctgccccgggtggagctctttgccagacagtccccgcccggctgggaggtgtggggaaatgaagtgaaaagcacgatcccggactttgggacaaagtgtcccgaggttaaaggggccggaaaggaggctgatccatgccctatgtgaatgtacccaacgacctgtcaaaagtaaaaaccaaaatggccctaaaccttaccaagcgccagctcatctgttttggctgtgcggcggcggtaggcatcccatcctatctgctggcccgaggctctatcggtaataccggggccatgttccttatgctggccgtgatgctcccggcgtttcttctggccatgtatgaaaaagacgggctcccggcggaaaaggtgctgaaaaacatcatacgggcccggtttctgcgtcccggagtcaggccctatcagacacaaaacatttacgccccctttgccggacggggcgctgtgagaaaggaggatgcgattgcgaaaggcaaatccaaccagcggaagaaaaaccgcaaaggctaaaaaccgggcggccctgtccgcccagcagacgatcccctatgtggcgatgcacccggacggggtatgcaagctccctggcgggctctacacaaagaccgtggaatatgaggacatcaattattccgtggcatccaccgaggatcagactgcgatctttggcggctggagctcattcctcaactactttgacagctccctgccgttccagctttcctttatcaaccgccgctcccactcccggagccgctataaggtaaacattccccaggcggatgatgattttaacagcgtccgggaggaatttaccgggatgctgaaaaaccagatcgcccggtctaacaacgggattgaacgctccaagtacattactttcggcatcccagccggagggatcgtggaggcccggccccgtctggagcgtgtggaggccgatgtgatgggcaactttaagcggctgggtgttccctgtgaaccgatggacgggcgggcaaggctggccctgcttcacagccagatgcatccgggcaaccgggaaccgttccgcttttcatggaaggacatcccgcagacggggctcggcaccaaggactatatcgccccggacagctttgacttccggcactcccgcctgttccgggtgggccagtattggggcgctgtttcctacttgcagattttagcgtctgagctctcggataaactgctggcagaaattctggagctggatgcggaaatgactgtaaccctccatatccagacggtggatcagctaaaggctatcaaaaccatcaagggaaaaatctccgacatcgggaaaatgaaggtggaggaacagcggaaggctgtccgggccgggtacgatcccgacattctcccgcccgacctcattaccttttccaaggatgcggcggagctccttgctgacctccagtcccgcaacgagagaatgttccttttgacttttacggtagtcaatatggcccctacccgccagcggctggaaaatgatgtgtttaccgtgggcggcatcgcacagaaatacaactgcgccctcaagcggctggactggcaacaagagcagggctttgtgtcctcgctggccctcggctacaacgaagtggagatccagcgtggtatgacaaccagctccacggcaattttcatcccctttatgacaagggagctgcggatggacgggcaggccctctactatggcatgaacgccctttcccacaatgtcattatggctgaccgcaaaaagctgaagtcggccaacggaatgtacctcggctctacgggctcgggaaaatcctttgcggcaaagcgggaactgctcaatgtctttctgaccattccccaggatcggattatcattgttgatccgatgggcgaatatgccccgttggttcgtaggctgggcggacaggtaatcgagattgccccggacagcccccaccacctaaacccgatggatgtggagctcaacatggccgccggggagagccctctttccatgaaagcggatttcctgctttccctgtgcgagctggtggtaggcggaaaggaaggcttacagcccatcgaaaagacagtggttgaccgctgtgtgcggctggtgtaccgggagcaggcccttgggcttgatacaggaaaaaccccgcttttgcaggacttgtacgaggagctcttaaaacagccggagcccgaggcccggcgtgtggcaactgcccttgagctctactgcaccggctccctcaacctgtttaaccatcccacgaatgtgaaaaccgacagccgggtggtgtgtatcgtgctgaaaaacatgggagaaaacctccgcaagatcgccatgcacatcacaaatgagtttgtgtcccaggcggtagataccaacttccgggagggcgtggcgacatggtgctatttcgatgagttccatgtcctgctccgtgatccgctaaccgccagctactttgtagcggtgtggaaaatgctgagaaagaaaggctgcgttcccagcgccctcacgcagaatgtgaaagaccttctggccagccgggagattgagaacattttagacaacaccgactttatgattttgctctcgcaggctcagagtgaccgggcgattttggcaagacagctcggtatttccgagcaccagctttcctacattacccactctaattccggcgagggcctgctgttttacgggaatgtgaccatcccgtttgtggatcggttcccgaagggggaaatctatgacctcttaaccacccgaccggaggatatgaagaatgaagcgaaaaccgaataaaccacgcccggaggcccaaacgcatacggaacccagaaacggagctgccgagcccggtggctctgcttttggggctggctctgaacaggagcccggggcggctggcacttcgggacaaagtgtcccaaagtcaaaattccggcagaaaagccagcaggaacaagcggcggcatccaagctccgcatggaaaagcggggcgaaaaacgggaggccgcccgggaaaagctggcaaagcagaagccgcccaaacaaaaaggcccgatccgtaaggcggcgggggccgccggatggggcgttcacggctttgtgcatggcaagctctacgaggtggagcaggaaaatgtaggaaccgaaggggcccaccgctcggagcttgccggggaggttgtcctgcggcatggctcccggtttgtaaaacgcaaagtccgggaacacccggccagggcagttagccgggccgagaccaggtatcagaaagcggcggcggattatcatttccacaccgccgcacaggagcatccggagctttcccaaaactattttacccggtactggcagaaacagcggcttagaaggcaataccagaagcgggcgaaggaggccacaaaacagagcgcaaaagccgccgggaaaacagccgccgccacggaaaagctgacagcccgggccgccgggtttgtgaagcgccatccagtcggatgcctgctggcgctggcctgtgttcttgtgatcgtcctgctccagtcctgttcgtcctcactggtgtccatcggcaacgccggagccggggcgctgggagccaccacttacccctctgcggatgaggcgattttaggggcggaggcggcttataccgggctggaggcagaactgcaaacctatcttgatacttacgaaagcacccacgattatgacgagtaccacttcgatctggatgaaattgaacacgatccctatgtgctcatttccctgctgtcggcgctccatgagggggaatggacgctttcacaggtggagggctccctgcaaatgctctttgaccgccagtatattctgacggagcgtgtggaggtggagacacgctatgacagcgacgatgaaccctattcgtggtacatctgctatgtgacgctggaaaacaaaaacctgtcccacctgcctgtttccctgttgagcgaagaacagatgtcccggtactccatctatatgtccaccctcggcaaccgtcccgacctgtttcccgactccccctatgtggacaaatacattaccaacccgccggagggttatgaggttccgggggaatatctggacgatgaaacattcgccgctattttctcggaggcagagaaatacatcggctatccctatgtgtggggcggctccagcccgtctacatcctttgactgctccggctatgtgtcatgggtgatcaatcattccggctggaatgtgggccgccttggggcgcaggggctttacaacatctgcaccccgaccagctccccaaggcccggcgaccttgtgtttttcaagggaacctatgataccccgggcgtgagccactgtgggatttatgtaggcgatgggcggatgctccactgtggcgatcccatcggatacgcaaacttaaatacaagctactggcagtcccatttctacgcctacgggcgtttaccatgattggaggtattctatggcaacaaccaaaagcatgaaaattcagaccgagattgataaggtcaaggccaaaatcagcgaacagcaggcccggctcaaggagctggagcagaaaaagctggaggcggaaaacagcgagatcgtggacatcgtgcggggcatgagcatcccccttgcagagctgcccctgctgtttgaaaagctgaaaggcggcgggactttgggacaaagtgtcccgaagtccgaggccgccccaactgcggaaaaggaggaaaactgaatatgaaacgatttcgagttttgacagcggcgctttgtgccgctgttttgttatgcggctttagcactaccgcctatgccggaggcggcgagggtgaggactacggcgatcccaccatggaaaccccggccccggagccggagccgaccatcacgccgggcgagggcttttctgaggagggaaatcttgtgacccgtgatctgctctatgacgagcacaccaacaagcagtttattaccgtccagaccagcggcggcaataccttttacattgtcattgattatgacaagcctgtggacgaggaaggcgaacagtatgaaacctactttttcagcgttgtggatgagggggatctgctggccgcagccgaggccgctggcgtggaacaggcggtctgctcctgtccggagaaatgtgcggcgagggctgtcaacaccgactgcccggtatgctctgtcaatatggggaagtgcgtaggtgcagagccggagcccgagcctgccccggagcctgagccggaacccgagaagccgggcaacgccgggatgctccttttagtgctggctgtcatgggcatcggcggcggggccgcatggtatttcaagatttaccgtccgaaacaccagcaggctgaccagcccgaggaggacgatggcggagagtacccggactatgacgagtttgaagatgacggccccccgtgggacgaggaggacgaaaccgaagaaaaggaggaaatcagatgaattttaccagcagtccctttgaacgaatgatgaaagaaaaaccccgtccccaggctcccgccgagaacaggccgcccaggggctccgcctgttgtggctgctgttactggcgggggatcgcctgtgtgtcctgctacaaggagcttttgaaggccggggctggcgggaggtgatggattgtcccgtgaactgacacgcaaggaaaagacagcgatccgctctcttgtggtaacatggtgcgccaactatgaccgggaatacggatgcctgccgctggatagcgattgctatatgctgggtaaatgctggacgggatcatactgccgctatttccgggagtccgtcctgccccttgatccggcgctggaagtggcccttatgagcgagggcccaaggccggattttaagatatgcccggtctgcggcgggcctgttcccccggacaggcggcaggcgtactgctcggcggcctgtgcaaagaaagcccaccgccgccagcaacgggaatatatgcggaaaaagcggggtgcatccgttgacaattagggcctgcaaaacccgcttatagcaaggctttccggggtcgtttcgttggcctgccgtatcattctacggtctggccccgcttgccccgatgctgtcaacatccatacagcgggactttgggacaatttgtcccgaagtacccgctttctgagaggaggaattatgccgaaatattaccccatcaatgaggaggccgcccggcgtgccaaaaacgccaacagcttttccgactatgttcccggctccgctaccgccgcttaccgtgaaatggtggatcgggcctatgccctcggggaacagcagaaagggcgtgtcgatcccatgtaccacgaaaagattgacgggctcatagatcgctatgcccgcaagctggcggagaacatcaaccagagcaatctcatagacgcccgtgtaccctccatcctcatcgccggaggctccaacttcccggtgcggaaaaaggaaaagcagaacgccgcccgggataagaacatgggcgaatatatgcagatcgagggcctgctggataaggtgcgctcaacaggtatgggcgggatcagcgcagacgatgaccgggctgtggaaaagctggaggcgaagctagcagggctggaggccatgcaggaggaaatgaaaaccgtcaatgcctactaccgcaagcataaaacgctggagggctgtcccgtcctgtccgccgaggaaattggaaagctccagtcctctatggcatccgactggcgcaaaaatcccgtaccctatccgtcctatctgcttaccaacaacaatgccaacatccgccgcacacgccagcgcattgaggatttgaaaagccagtcggaatattcgggctgggcctttcccgggggccgggcggaaatcaacgaaggagaaaaccgcttgcagctcttttttgaggaaaagccatcggaggaacagcggcgggaactgaaaagcaacggttttaagtgggctcccagccagggggcatggcagagacagcttacgaaaaatgccatctatgcggcgggccggatggaatttttgcgcccggaggatgggcagagcccttaccagctccagccctttgcccggaaaacggaaaaggatatgacacgatgaaggaggtgtatttgtggacaaaaatcaaggctattccattttgaaggctgtgatgctggaaaatggcaggggctttgcgctggggcatcatcccacagccccatccccctatgtcacatgggcctgttacgatgataagaacggccagcggcagtatgaatggggacattacggcaacgatctggccgctatggaacaggatttttcagaccggataaaggactatcagcggctttaccatgtggagatcgtgcagaccgaggcccccggcctttacaagtattactctacccaacggcctgtggacatcgggacattccccaaaccgccccacaatgccccggatgagatcgtcaactatgaccgccgcatcccggtggagggcggcgcatttctggcatgggggcatctgacttatacaagaccgctgaccgaaaaggaggcgtctgactatgagctccgtcctgcccccgtcatttctgaattatcccgaaaaaacgatgacaggcccctctctattgcccagcagatgaaagaggccggagctctggccgaagccagccagggcgatcccatccataagaaaaaggcccccgaccggggcgaccgataggaggatttgtatggaagaaagatataacccgatgaaaagtgcggagatcgccaccgagcacaattacaatatgctggacggtgttctcaataaccaggccccacccccggaggaaaaggagctggataaggttaaggaaccgccccacaagtgccggagccgggaacgggaggaacgatgacaaagaaacgccgccgcccgatccatctccatgtgatggtgtccgaggaggagcaggcccttattcaacagcgcatggccgaggcgggcatccgcaatatgggggcctatatgcggaaaatggccctcaatggctatgtgctccatgttgacctctcgcccgtccgggagctggtatcactccagcggcggtgctccaacaacctcaatcaagtggcgatccaggcgaatacctacggtgggatttaccccgaggagatcgccgctttgcaacgggactatgccgccctgtgggggccgctgtccgatctgctgaaaaagctctccgcattggtggagctctgatcctgccggggagtggcgtatgccgctccccggttttcactacttcgggacaatttgtcccgaggtgctgaaagccggaggcatccttgttgtccctcccggacagaggtataattatcatgtaaggaaccataaaccacacttttcaaggaggtatcaagcgatgcggatcattctgaaacttttagcggccccctttgttctggccctcacgctccttgtggcagtattgaattttgctttttcctttgcgtcatgggtgttctgcgccctgtcctttctctgtctgatcggagccctgtttgctttattcacgggggatcgctggggaatacaggggcttatgatcgcctttgttgtttcgccctttggcctgcccgctgtggcggagtggctcattgataagctggacagtctcaactactcgttaaagagttttattacaggataacgcttcgggacaatttgtcccgaagtcctatggacatttaagaaacagatagtctataatatcttcattaagcattagtagaggtgcggtatgattatttggattgatggggctaatggtgttggtaaatctcatgtagccgcaaaacttgaggaactcttatcaaatagaaatgctgaatatatagagtctgatttgtattgggtggaacttattcaaaacaattttttgaaggcattgaatggttttgagccatataataataaatattgccttgaaacaattagaacagtgttagaagaaaaatttcaaaaacataataagatgcccatcatatcaatgtctcttgttgataaaagatgtcaagaagaacttttagattattttgaaaagaaaaatgttccgatggtgcatatcattcttgaggcagaaaaagaaactataatatcacgcatagaaaatgatcctatccgggataacaacgcacaaaatcagcagaaatcgaagatagactggcaaattcaatatttaagaatggcatatccgagtgcaattagaattaacacagaaggtaaatctctggatgaaatagctaatgagatcgtaactttgctgtaagaaaataagcaagatggcggctggacggacagccgccgctttcttttggaaggaggtgtgctcacggctacaacttatatccggccctacaaggcggctgggaaaggcgctgtccagacaatggaggaacgctttgactatgggctcaatccgaaaaagctgggagccctatcctcatacctctgcgatccggctacggctcccgctgagtttctgctggtaaagagccagtaccaggcggaaacaggccgggccgtagagcgtggagccctgttttttcaaatccggcaggcgttcccgcctggcgaagtgacagcggaggaggccaaccagatcggctatgaaacagccatgcgctggacgaagggaaagtatcaattttttgtctgcactcacacagacaagggccacctccacaatcacatttatttcaattcaacggcctttgaccgctcccggaagttccataattttattggctccagctttgcactgcggcggctctctgaccgggtgtgcattgagcatgacctctccgtgatccaaaatccaaaacagcacagcaagggccggtatctccattatggccagtggattggggaaaagccgccctctgcaaaacaacgggtgcggctggccatcgtggaggctctgcaaaaacagcccaccgattttccagcgtttctgaggcttatggaggagtccggctttctggtaaagcatggccgtggcggtgtgatctcgttccttgctcccgggcaggataagcccacccgcctgcgggcatccaccctcggggatggttttgatcccgaggacatccggtctgtaattgccggggagcgtccgatcccggagctcccgcaggaggccccggctcctgcccgttgtgtcaatctgattataaacattcaagagcgcatggcacagggcaagggcccggcctatgaacggtgggccaaggtttacaatctgaaacagatggctgctgcgctccagtacctgcgggaaaataatctgatggactatgaggcgctggcggccagtacagaaaaggcggtagagcgttttcatacgctgtccgaggaattgcggcaaacggaggcggagctggaaaagacctccgggctcatggcggctactgtggactacgcaaaaaaccggcccgtgtttgatggttacaaggcggcccggtacaataaaaaatatctgtcggagcatgagacggagcttgccgcttaccgggcggcccgggctactatgaatgagcttttggacggtgcaaaactgccgaagatggcggatatgaaaaaggcccgccaggaattggcgggaaagaaaaaagctctctatgcggaataccgcaaggcccaggcggatatgcggcaggctgtggcggtcaaagcgaacattgatcatctgctcggcgtgacggacgggcgggaaaataaggcccaggagcgatagcgacaggccgcagacaacaggcgcatagcgccgggactttgggacaatttgtcccgaagtccagcgggtttggggagctccccaacaagcatttttgcgggcctgcggccagcaaaaatttcggagtgtggccacacccgaattgcttgccatttcgtgcgcttccgctacatggcgcaaaaaaacggaggtcacgcttttcttacgcatcctccgtttctctggctttcttaatgccctcggctgtggcttctatcacgacaagctctttttcattcatagaatttaggagcacatcaatgtgttttctgcaagaacttgtctgcgcccctccgtccgcatgaataaactgatctaccgaaatgtcaaacatcataataagtttaacaaaaagatcaaagctgggatattgccctttgttttcaatattcataatggtacgggagtcacggtctactaattccgcaacataggcttgtgtccagcccttttcttctctggctcgtttgagagccgccccgaggccatgaaagtcaaatcttctttcatcttggttcattctcatatcaccctatatcattctacatttcgtgtcagattatgagaatgtaatgaaattttacattaagtagtattttgcttcacatccgtgtgggctctaacttgtattattcgagacagagaactataatatatcctgtggaggtgcgaaatggactatatgacattgaaagaggccgccgagaagtggggcgtgacacctcgtagggtaaattattattgcgccggagggcgcatccccggcgctgtgaaaatggccggtgtttggctgatcccaaaaactgcggagaagccagttgatggccggacaaaacaagggaaggagctgcgctatgaatagaattttgattatagatgatgacagagaactgtgtgctttgattaaacgcagcgtacaatcggaacatattgaagctgatttttgtaataccggaaaagagggcttgcagaaattaaaagagcaggagtatcagcttgtggtgctggatgtgatgatgcccggtatggatggctttgaaacgctggaagaaatccgcaaagagaacagcttgccgattttgatgtttacatccaaaaatgacagcatttctaaagtgcggggcttacgggccggggcggacgattatttgacaaaaccgtttgatatggacgaactgattgcccgtattgcgtccctcattcgccgctacacccgctttaatcatcaagccggagctgtgcaaaaactggattttgacggattgcagattgaccttgaaaatcgttctgttactacatcaaacggcacttttgaactgcccccaaaggaatttgatctgctcctgtactgtgcaaaacatcaaggaaaaattttgaccaaacagcagatttatgaggaagtatggggcgaagaatatttctatgatgacagtaacattatggcgattatcagtcggcttcgtaaaaaattagaagtcaatccttcaagcccaaagtatatacaaacggtcaaagggattggctatcggtttaataaggaggtgtagccagcatggaaatcatcgttttcttgtccgttgtgattgctattggggctgtgttgacttccattgttctcgttcagcgtgtaaaaaaacaaatagcagaaatgaccgatgtgttggttgatgtgaaaaacggaaatggtaaccggcgtattctgtctgcaacaaatgaactgacagcccctcttgcctatgaaatcaatgagatcgttgtggcctatgaaagcagactttcgattgtccggcagacagaggaaaccaaccgccagcttatgacgagcctttcccatgatgtccggacaccccttaccactctaattgggtatcttgacgccgcacacaaagggcttgtcacgggaaaagaccgggatgactatatcgaaaccgcccgccggaaagcccacgatctgaaagaatatattgatgtgctttttgactggttcaagttaaattccaacgagtttgctttggagatccagagccttgaggccgcagagctgacaagaaatatcctgatcgactggataccgatttttgaggataaacaggttgattatgacattgatattcctgaacagcctgtccgggtaaggttggatatggacagctatatgaggatcgtcaataatctcattcaaaatgtaattgctcacagtcatgcggacaaaatcaaaattgtcctgtcaaagaaggaaaacaacatggagttactgctggcggataatggggtgggaattgagaaagaagatttgaaacatatttttgaacggctttataagtgtgataaaggccgttccgaaaaaggaagcggtcttggtctttctattgtccatcagcttgtagaaaagatgggtgggagtataacagttgaaagtttgctgggaaaaggaactgaatttatgttgctttttcctttggagatttaagcgggttcccgtctttatggcgggagcctttgtcattttaccggatttcaaattgcaaggttaatgcaaggttgcggcaaggttaatgcaaggttggcgtgatagaataccttacagaacaggaggttttgaatatggatacaaattacatcattgaaacaaaaaatctgacgaagcaatacggctcacaaaagagtgtggctgacttaaatatccatgtgaagcgtgggagaatttatggtctgctgggcagaaacggagccggaaaaaccactaccatgaaaatgctgttgggcttaacgaagccgacttccggggaggtcaaaatctggggaaagtctttgcaggggaatgaaaagaagttgttgccccgtatcggaagcctgattgagtcccctggcttttatcccaatctgaccggcacagagaacctgcgtatctttgctaccctgcggggcgtaccaaacaatcatgccatcaaggatgctctggatctggtaggactgccttacaaagataaaaagctcttttcacagtattctcttggtatgaagcagcggcttgctatcgcccttgctgttatgcatgatccggaacttttgattttggatgagccgatcaacggtctcgatcctatcggcattgcagaagtacgctcctttattcgggagctttgcgacgcaagaggaaaaaccattttgatttccagtcacattctttcggagatttccttgctggctgacgatattggaattatcgaccacggcgcattgctggaagaagaaagccttgctgagctggaacaaaaaagcagtaagcatatccggtttacgctctctgatactgcacaggcggcaagaatattggaacgcaatttccatgaaaaccatttctccatacaggacgaccacaatctgcgcctgcacaatctggatctgcctgtggggaaaattgtaactgcctttgtagaaaacggattggaggtctcggaggcgcatacttgtgaagaaagtcttgaagattacttcaagcgtgtgacagggggcgaaggaattgcttaaactaatcaaatgcgaatttttgaaattgaaacggaagaaatttattccgctgattattctggcggctttcctgtttccgatccctctgacctatctaatgacaacgccctctatgatggagcgatatacggatcaggcagatgcttttgatggactttttaatatggtgctggggtatggtatccagtttttactgccctgcattatcggagtgattgccgctatcctgttctttatggaacgcgacaacgatacattcaaaaatctgcgtacaattcccgtaaccagtacgcaaatggtacttgcaaagattattgtcctctttctctttggaattatcttttgtgtagcttctacgctggcaacaattctctgtggatttggaacattagaagtttatggaataggctataaattgtttttagcggttgaaacaggaattttcattacggcaggaacactcccgttgattgtccttgttgtcttttttagtaagacctatgttttttccattttactgtgtgtcttttacagtgttctgaacatgagtgctactgcattgtttgacacactgcctaaaaccatgttatggcttctgcccacgccgctgactacattttggagtgcaggagatatggcggctcatggaataaaaatggacttggagcaaatggcagggctaattccttcaacatttcaagttgtattcattcttgggatcatggcaatcgtttcgttcttactgattgacagattatataaacagaggggggaataaacatggttcgcattgtaaaaacagaattttataaattgaaaaggtatcatattctttgggcgggcgttgcgcttatgctcctatccgtcctgctgaccttgtttacctctatggcgaatgatggttccgtttgggatttcgcctatcttacagaacaggtcatcaagaacaatatgtccatgatttttccgatgtgtatcagcctaattgctggatatatgatttctcgtgagcagacggatgacacattgaaaaatattctgactgtgccgatctcttttaagaaactgctgaccggaaaattgattgtgtgcggcgtattgtctattattttcgggctgatatgcagcttgtttacaatcatagcagaaatgattgtgggatttcccggctttgagatttccttagctctaaaagcaaccttgcagattaccgcagttaatttctttttatatcttgcggttctgccgattatcgctcttacttgtcggaaggcaggtagctttttagtcggtgtaatcattgcttttgtctatggatatggagggatgtttgccgcaggaaatatgacattagcaaacctttatccgattaccgcaagtctcggaatggtaggataccgtagctatgataccgcagtcaactggaatatcggaacctgttcttgcagtcttgtgcttgctgtcgttatttctgccatcttgattttgtgcatgaaagagcgagaagcaacccaaacaaagaaaaaggcaaaaaaggtagcaccaaagaaaggctggtgatgattttatgaagaaaatagttttagcattggcatttgtccttttgggaagttttatgctctctggctgttcaaaagatgaaattctcgatcattataatagtatcgttcagtcagccggagccatagagcttacaggaaagttatctttggaaggaacaaaagaaaaggggattgatgattatacgggaacttatacggctgattatgagaatttttcagatacagagtatttgttcggaggaacttccataaagagagaagccggtaaggagctgtctattgactgcactttggaggttacggaaggtactgcaaaagtattttggatttctggatcggatgaagcaatcactttgattgaagcaaccggaacttatagtgacacaattacacttcctgatggtggaaattatatcggcattgagtgtgaggactttactggaaacattgaattgaatattgaataacattctgccggacgacggcaaaagaaaaaaagccgtcgtaaagcagatacatttccatgcgcctatgaagcggcggctttgattttcagagccgccgtttcttttcgtctactctaaaccaacgatgatctaacaccgtgtaaatccacggcggcatataggaggattgccgccgtgtctatttttgccttttttcacagtacccatgatcttcaccagctaaaaaaagcgtagctccccctccgggacagtctggttatgaatgtgaaattaaacagtacataaatgaatatataacttcatgcgtctgtgcggctttgtgtcgcccaggcgcttttttgtacttcgagacaaattgtcccgaggtacgaggcggctccccaggatgccgctccccgccgagccccgtttcggtcactcatccacccaacaccgaaacggaggtttatttatgactacaatcaatctgaaggatttttattattggtacacacaggatcagtttatcgaagtttctgacgaggtagccgaagtgtttgtggccgatgcccggcacgaaatggcctaccagcggcggctctcccggcataaggcgcagtattctctggactgcgatgacgggatcgaatattccgcctgcctgcatgagccaacgccccaggagcttctggagcgcatggagctgttcatccgtctgtggaacgcactcaattctttgccggagatccaggggcgcaggattgatgcccacatcattcttggaaagagcatcaaggaaattgccgaggccgagggcgtacatgaggagtctgtccgccagtcgatcaagcgtggccttgagcgcatgaaaaaaactttttgattttttcattttccccacttggaaatgataaaaaaatgtctcggtttatgaaaggagatattcttctttccgcagataaacagcggcggccccgggcatagtccggggagccgcgcgacgggtgcgctgtgactttctccattgggaaaagagcgaacaacaccaacgccgcaaatgggccaggccaccccacggccacgatccggcataggacaggctggccgcctgtccctccgggccgccctctcatctgtgcgggatcgccgtcccgaaagttgttgtctttggacaggtcaagaaaatgtgggcggcgatccctaaattttaggaaagagaggtacaatctatgaactatgatcccgcagaattggcggccctgttatccgagccgtggagcaacggagcttgccgtggttatgtgattatggcgatggaaaactgcggctttgctggcgatgacatccgccgcataatggccgagctccatgaactgtttgacttcgtttctctggaggaggccgaggctcactatcaaaaaagccttttctgacttcgagacattgtgtcccaaggtggagtgaggcaagagggcagcatcgtttaggtgctgccctcttgcgtttccccacgatatgcgggaggcgtatcctatttttgataaggaggttttaccgtgagattaacggcaaaggaattggaacaaatgaaaagcgttgacatcggcgcagtggctcccgagtccctgccggatgtgagcggtatggcctttgacacctctctcccccgggaggagcggatcgctctgtttttgcaggccgtagaaaatccatactgcttttgcatcggcgggattggtgtgaaaattgaatttgtggaaagcgggccgtccttgcaggacacgctgacggactttctgctccggcaaaaaagcgggctgtaacttcggttatggcccgtttctacttcgagacaaagtgtcccgaggcggaggcatccttgttgtcccgcccgggcagaggtataatatagatgtaatgtgatagggaaggaggaacaatggcacgaacaaaaaacagaggatttaagcagagtttctctccctcttataccgtccgccgctggcggctgggcgcatacatccggctttctaaagaggatttgaaaaaagttaaagaaggcaaggatgacagcaacagcgtgaaaaaccagcatgacctgctgggggatttctactttaagcatcaggacgaatttgaaagcatcgctgagtatgtggatgacggctacacgggaacggacgccaaccgggagaatttccaacggctccttgctgatgttatgagcggcaaaataaactgtgtgattgtcaaagacctttcccgtttcgcaagaaattacagcgatgcaggcagtctgattgacaacctgtttgttcaaatgggcgtccgctttatcagccttgccgagaatgtagacagctaccgtgacccggacagcgtttccagcattatcgtccccattacgaatgtaatgaacgatcaatactgctatcagacttcaaagaagatccgccaggtatttgactacaagcggcgcaacgggcagtatattggctcctttgctccctatggctatgtgaaagatcccaaggacaagcacctgttgattgtcgatcccgaggcggctgaaatagtcaagctcatttatgacctgtgtttgcagggcatggcccggcggtctatcgtctatcacttaaacgatcacggcataccgagcccggctacttaccgcaaggaaaagggcctgcctgtgagctcaccatcggacactcccctgtggggcgataaggccgtaacccttattctcacaaacccgatttataccggggacttggtacagggccgccgccgggtgaaaagctacaaggtacaccagatcgaggaagtgcccgaggaggaatgggtacgagtgcccgatactcacaaggccatcatagaccgggagacttttgaaaaggtgcaatccctattaaagcgagatacccggcgggctccccggacaaaggaactccacctgttcagcggtttcctccgctgtgcggattgtggaaaatctgttacccgaagctcaagcgggcaaagtacccgttatctttgctctacctacaaaaaccgctcccggacggcctgcaccatgcactctatcaagcatgagcggctggaggccgctgtcctgttcgctgtacggcaacaggtacatctggcggtttcctactccgagattatcgcccggatcaattcggctcctatcaaaaaaagccagtctttccgactggacgatctgatagccgccaaggagcgggagctggcaaaagttacccggtacaagcagtctctttatcaagactggaaagacggggaaattacccagcaggactaccgggatatgaaagctgattatgagcggcaggccgcatccctctcggacattctggcccggctgaccgctgaacgggcggagctggcaaacggcgtaaataatgagcatcctgctcttatagcctttatgaagtaccagaacattgaaacactcaaccgggaaattctgattgagcttgtagaccatatcaaggtttacgaaaacggcaatatcagtgtgaaattcaaatttgctgacgaactccgccggattgccgagtacattgaaatcaacaccactcaaaaccccgctgtggcgggctgatacccgccacatacctttctgacagtgtgtattcctaataagaaacattcatatgcttgctacgaaacttatcacattacaaatcaaagaaaggacgggaaaggaatggaacgaaaacaagaacaagatacaacagatgataggcagaaacagggaaatccggcagatgaaacagtgatttataaaatcggcggcacattctatgaagtgtctacctcttgcggcggctctgaaccgctttttgaaaagatgaagcggctcataaaatcagaaaatctcaaagcgcctactgacaaaggaaaagaagtccgctataatgaagatagcaacctgtctgtcgggcgttcattacaggaggaatgaatatgacagcaaatacatataagcccgaacagataaccgcattatatgcccgtttaagtcaagaggacgcattagacggggacagcaacagcattgtcaatcaaaaagcagttttaacaaaatatgcttcggataacggctttacaaatcctgtattctttattgatgacggcgtttccggtgtaacttttgacagaccgaattttaaccgcatgattgcagagattgaagccggaaatgtggcgacagtcattgtcaaggatatgtcccgcttggggcgtgattatctgaaagtcggctactatacggaaatctttttcgttgaaagagatgtacgctatatcgcaatcaatgacggcgtggacagcgcaaagggcgacaatgattttactcctttccgaaatctgtttaacgatttttacgccaaagataccagtaaaaaagtacgggcaatcaagaaagcgcagggcatggcaggagaacatctgactaagccgccctatggctataaggtagaccccaacgacagaaagaaatggattgtagatgaagaagctgccgctgtagtaaagaggatttttgatttatgcgttgccggaaaaggaccgtcgcaaatagccaaagtacttaaagcagataaagtgctgatagcaaaagcatattattcaaagaaaaaggaaaaagccttgcccgacaatccatataactggaaagacagcacgattgttggcattttagagcgcatggactactgcgggcatacggtaaacttcaaaagctattccaaatcccacaagctgaaaaagcgtattcccaccacaaaggaacagcaggcgattttccgcaatacacatgaagcaatcgttgaggaagctgtctttgaaacggattgcagaacttgaccggattttcaagcggatttatgaggacgacatcaacggcacaatcagccatgagcggtttttgaagttgtccgcagagtatgaagcagagcagaaagaacttacagaaaaggtaaaggcagaacaacaggaagtagatacctacgaacagaataaaagtgactttgacagcttcgctgccattatccgcaagtatgtgggaataaccgaattaacgcccactatcgtcaatgaatttatcaaaaaaatcgttgtccatgcgccggagaagatagatggcaagcgttttcagaaagtggatattgtttttaacttcgtgggagaaatccatttgccgactgacccgcaaacggaacagaaagaaactgataaacaggaaaagacggcatagcccttgaatggggctataccgcctaattgaaaaatatacttccttgtaaccgaaactccttatgttttgccctcttttttacatacgccatacagactccgtcagaaccgctcaaaactggactgttgcgtaacataacgtgatatggtatactaaaacttacataatttcgcactccaagggcacgcggttttcgtctgttttgttaaaaaacagacacaagaccgatgatggcggccggaccaggttcgcggcgcagcctgcataaacgcggcgcccgccccactgtccgcggcgcagccggctaaagttttttgccaagctttttttcaaaaaagcagggcttttgacaaggagggtatctatgactgtacgcgatatccaaaaaattctgcgcgcagatttgctgtgcgaaggcgatcacctcgacgcccaggtgcacacggcctgcggcagcgatatgatgagcgacgtgcttgcatatgtcaaggatcagagcgtccttctgacggggcttgtcaatgctcaggtggtgcgcaccgctgagatgatggatatgctttgtattgtttttatacgcggcaaacgcccggacgacgcaattatccgtctggcgcagcagcgcggcatcgccgtcatgacctcgccctaccgcatgttcacagcctgcgggctgctttatgaaaacgggctgaagggtggctgtgaaacggatgtctgaatcaattaaattgacgtacaacgtgccgggcgacgatttcacacgcgcgggcgaagcctccagcgacgtcaagggagtgcttaaaaagctggggctttccccggttgtcgtacgcaaggttgccattgccatgtatgaaggcgaaatcaatatggtcattcatggaggcggcggacagatcgcagttgaaatcggcggcgaggatatccgcatgtctctttctgatcatggccccggtatccccgatatcgcccttgcgatgcaggagggctggtccaccgcgcccgaggaggttcgcaatcttgggttcggcgcggggatgggacttcccaacatgaaaaaatattccgataaaatggagatcatcagcgcgcccggcgaaggcacaaccgtcaatatgatggtgcggatcgcttgattaacagctcaatcagtccctttttacacccaactgaagggaggccgtccgcatggatacggcgaatttttttcactccgtaacgctcgaccgcgacaaatgtcacggctgcatcaactgtgtcaaacgctgtcccaccgaggcgatccgcgtgcgcggcggcaaggccaaaatcatcaaggagcggtgtatcgattgcggcgaatgtatccgcgtctgtccgcatcatgccaaacaggcaatttttgacccgctgtctgttatggaccgcttcacctataaaattgcgctgcccgcgcccgcgctctatgggcagttcaacaaccttgacgatatcgatctcattctcggcgcgttgctgctgatgggctttgacgaggtgtttgaggtcgcgcgcgccgccgagcttgtctccgacgcgaccaggcgctacatggccagggaggatatcctgcgccctgtggtaagctctgcctgtccggctgtgctccgcctgatccgcgtgcgttttcccgagctgatcggacacgttctgccgatgcacgccccgattgaggtcgcagcgcgtctggctaaaaagcatgccgctgaaaagacgggcctgccgcccgagcagatcggcgcgatctttatcagcccatgcccggccaaggtgacggctgtcaaaatgccgcttggctctgaaaagagctgtgtcgacggcgttctggccatccgcgaggtctatcccaaactgatcagcctcatgcgcgaggtccccagttcggtcgatttggcgcgtacagggcgtatggggatcggatggggcagcagcggcggtgaagccgccgccgcgctcaaggagcggtatctcgcggcggatgggattgaaaatgtcatccgggtgctggaggatttggaggacgaaaaattttacgacctcgattttgtggaactgaacgcctgctccggcggctgtgtcggcggcgtgctcacggttgaaaacccgtatgtcgccagggccaagctcaagcgtatccgcaaataccgccctgtgtcgtgcaaccatatcgacggggaggatctctccgcctttttctgggacgaggcggttgagtatgagcctgtattggagcttgacgccgatttccgcacggcgatggaaaaaatgaaaaccatgcgcgaaattgaagcgcgcttatacggcatggactgcggttcctgcggcgcgccgtcgtgcaaggcgctcgctgaggatattgtacggggctttgccactgaggaagcatgtatctttaagctgcgcgaggagatcgacggcatggcggaaagcctgcgccgactttcacgcgtaatgccgaaggcggacggtgacaaatcaagatagggggcctgatcatgacagtccgtgaaactgcggatattctgcattttgaaattctgaccggcggcggcgcgctcgaccgcccgattcaaagcgtttactcctgcgacctgctttcgtttgttatgggccgcgcgcccgccgacagcgcatgggcgacggtgatgggcaatgtcaacgcgatggcggtcgctgtgctggcggatgttgcgtgcgtcgtgctcgccgagggcgcggcgctcgacgacgatgcgcgcgccaaggccgaacagaacgatatcgccgtattgcgcagcagcgatccggtatttgaaacgtgtcttgcgatctatactttgctcaatcgctgacggcgggccgcccgctgcggaaaaaggggggaagcggccatgcgtcctgtgttttatgatttgcatattcactcgtgtctgtcgccctgcggcgatcaggatatgacgccgaataatattgtgaatatggcgctgctcaaagagcttgagctgatcgcactgaccgatcacaactcctgtaaaaactgtccggcaattatgaaggcggcagccggcacaggacttgtcgtactgccgggcatggagctgaccaccgcggaggaggcgcatgtcgtttgtctgtttccggcgcttgacaatgcaatggcgttcgacgcctttgtccacgaacgcctggcgcctgtcaaaaacgcgccggacatctttggcgaacagcttatcctggataaaaatgacgatccgatcggtcacgaggaccttttgctcgtcaatgcgacctcgatcagtatcgatgaagcgcctgcggccgtagcgcagttttgcgggctgtgttttccagcgcacatcgaccggccaagcaacagcgttctgtcaaacctggggggcatcccgccggaatgcggctttcatatccttgaagtcgcacatccggaacgcttttttgccggcggtgcgcacagcgatcttcaggagggctatacggtcgttacaagttccgacgctcacgatctgggcaatatctccgagcgcatacgttgtatccatcttgaaaccatcgactacgccggactggcggcgcgtttattatgaagaaacgggaatggattattgttgcggtgctgctggcggcctgtatcgcggctgctttttttctttaccgcccaaaagaggcggccggcggcgtagttgcggttatctctgtagacggagacgagctgcgccgcgtcgacttgtcggccggtgaagcgtataccttccggattgaggaggaaactggcaggccggtttcctttgaggtgcgggatggacgcatccgttttatcgacgtcacctgtcccgaccacctctgtgagcaaacaggctggtgtcaaaaccccggcgaccgcgccgtgtgcctgcccaaccgcacgtcgctgatctgttacgacaaggcttccctgtaaggcgcgtccgccgtctgccgtatccttcgcggtgcggcctgtataagcgcggcgcctaacccgctgtttgcggctcagccgaataaggtttttctccgaagccttttttcaaataggcttcggagaaaccggctaaagttttggggcatacctttttttcaaaaaaagtatgtggtataatatgcgcagggcaaacggctacgccgtttgcagccgccatctggcggctgccgctgcaaagcggcggactgcgcatgttacaccacatccaaaaccagctctgctggtttagctgccgctttgcggcagccaagcccttttgggcttgccgctgtggtataataaccgcagagcggttattataccggggttatgcccaacggctcgccgcttacgcggcaaccgccttttgatgggcaattatcccatgccgcttcgcggtagacaagcctgaacgggcttgccgctgtggtatactaattaaaaacgggccgctgccgcgcggcctctgagaggtattttgcaatgcacgatcatgatccggaaaaaagggttgtagactttgacaagcttcgccagatgcggagggagcagggacgcgcacgaaagcgcacaatccgcagagtgatcgcaggggcagccgcggcattgttgctgatcggaacatttttattctttcagcttcgcgaagcgttttctggcagcggcttttggcaaaatttcagcgcttccgcacccgcggcgcatacggaaggctcggagcgcagcgcatgaaacgagaacggctttatattatccttgcgcttgttaccatctgtttttgggggacaacctttgtttcaaccaaaatcctgctgggtgtgctttcgcctattcacatcatgcttttgcgctatgtgatcgcgtatgtgtcgctgcttgcaattcatccaaaaatccaccggccggaaagcctctccctggagtttcgctatgtcgcggccgccctgttcggcagcacgctttactttctggcggaaaactttgcgctttcctttacccaggcggccaatgtcagcctgctgatctccgcggcgccgattctcacgtcgatcgttgcgcatctgaccactcgtgacgaacacctgacgcgaaatgcggtcggcggtttttttgttgccatgactgggattgcgctcgttgtcttcaacggcagctttgtgctcaagttatcgccaaaaggcgacctgctcgcggtcgccgccgcgctctcctgggccttttattctgtaattctgcgcggtatccgctccagctacccgcctgtatatgtcacgcggcgcatctttttttattccattttgacgatgctgccatgtctgctgtttgacgccgcgccatttgatatggccgtgctgaaggagccgctgatcctcggcaatctgctgtttttagggctgatcgcatcgtcgctgtgttatgtgctttggaattatgtcgtcgcagggcttggagcggtgcgttccaacaatttcgtctatttaaaccccctcatcacaatgatcgcttccgtcatcgtactgcatgagcgcatcacgccgctgatgatcgcaggcgccatattgattctgctcggcgtcattgtgtcggagggaacactattaaagcggcaggacactgccgcccagaggtgattgattggacaaaaaacaaatcaagggatattgtaccgtcgctgcgtttaccgtcgtgctttactttgtcctgagccatccggaacgcgtgggacaggttgcttcggcgtctgttcgcctgcttatgccgtttttcattggtgtggtcctggcatttgtcctcaacggcgtgatggaaacgtttgaaaagcatgtgttcgccgatttgcctcgccgttttccacggcgcgccggtcttgtacgaccgctttcgttgatcagcacctatctgctggtcctggcggcactggtggtgctcggctggacggtcgtccctcagctcggtgaaagcgccatcacgctcggccgcaatatcccggcttatctcaactcgcttgccgagcttgcagcccgctttcagcacgaatgggtactgccgcccgaattttacgagcagcttaccggctggctgtcaggtctggctgattttctgctcaacttcatcgccgaatttgtgccgtatgcgctcaatttcgccgcgtccttcgggggcggtattgtaacgctcgtcattggcgtgatcgtctccatccatgtcctgctcacaaaggagcagcttctttcacaggcacggcggctcaatcgggcgtttctgccgccaaaggccgcggacagcattgccagcgccgcgtctgtcgcggccggcaccttccgccgctatgtcagcggccaggcgcttgacgcgctgatcgtcggcgcggtcagcgtgatcggcctgtcggtgctgcgttttccatatgctgtgctgatcggcgtcgtcatgggcgtcacaaatgtgattccgtttttcgggccgttcatcggagcggtcccaggggtactcatcctcttgatggccgacccgatcaaagcaatctggtatattctgtttgtcgtgattgtccagcaggtcgacggcaatattatcgcacccaaagtgatcggcggttcggtcggcctgccgccgctttgggtgctgttcgccgtcaccgtgggcggcaacctgttcggcattgccggtatgattttgggcgtgccgctgttcgccacggtctatattttgcttggccgcgccgtgcgcgcccgcaatgtctgatccggcctttctggcgcgcgtgacccgtgcgcgggtcacagcggcatcgtccgctatggcatccgacgccttcgcggggcttgatgatttatcacagaacacaccggcgtgcgcccgaaaaatctgtgccaagcagaggcggggataacataaggggagggtcgccgacccgccccttgtgaggcgcgaaaaggggcgcagccgcggcttgtccgcgcccggcgctatagcgccggaaagccccgaatagccggccgggcaagcaaagcggccggcggtgggcaatccgcgcacggattgcgcgcgccaaaagggaggtaaaaaacatgattgattcctgcggacgacgtatcgattatatgcgcgtatccatcacggaccgatgcaatctgcgctgccggtattgtatgccggaggaccagccgtttattgagcacgatcaaatcctgcgctatgaggaaatcatccgtatctgccgcgccgcaacaaagctgggcgtgcgcaatatcaaaattaccggaggcgaaccgcttgtgcggcgcggctgctgtgagctgatcgaacagatcaaggcgctgcccggcatcgagcatgtcacagtcacgactaacggcgtgttgctcgaggaggttgtaccgcgttttcgtgaaatcggcgtggacggagtcaacatcagcctggatacgctgcggccagatgtttacgccaaaatcaccgggcgcgacagttttgacgctgtatggcgcgggctgtgcgcggctgtcgacgccgggctgtgcgtcaagatcaactgcgtaccgctttccggcgtcaacgaggacgagctgtgcagcctggccatgcttgcgcgcgactggccggttgacgtgcgctttattgaaatgatgccgatcggtttgggcggctccatggagccggtgccggctgagacggtgcgcacacacgtgcgcgaggcttttccagatttaacgcccgacccaaaaaagcatggatttggcccggcgcgttatttcaccagcggcgctctgaaaggttccatcggctttatcgaagccgtttcgcacagcttttgcaccggctgcaaccgggtgcggctgacaagcgaggggttttttaagctctgcctttatcatgatgacggcgcggatctgcgcgcgctgttgcgcggcggcgcgaatgacgacgagatcgccggggcgatgagccgcgctattctgaaaaaaccgcgcgcgcatgcgtttataccaggccaggccgccgaggaatcgcgcggcatgtcacaaataggagggtgatccatatgggaattgtcagagctgtctgcatcagcgaccggcgcggcatccagaaaatcgatgtgggcgcggcaaccttcgcgccggactgcggcatcgtcaacgacgcgcaccgcgggacatggcaccgccaggtgagcctgctttcttacgacaaaatcgaggaatttaaacgccgcggcgcggatgtcggccccggggcgtttggtgaaaacctggtcgtggagggctttgatttccgaagcctgccggtcggcacacggtttcaatgcggcgacgtgcttttggaaatgacacagatcggcaaggaatgccactcccactgtcagatctatcacaagatgggggactgtatcatgccgcgcgagggcgtgttcgcgcgcgtgctgcacggcgggaccatctctgtcggcgacgagatgacagctatcccgccggcggccgacgcgccgctgcgcgccgccgtcgtcaccctcagcgacaagggcgctgcgggccaacgcgtcgacgaaagcggccctgcggctgttgagctgcttgagcaggccggctatgaaatcattgaaacgctgatcctgccggatgagcaaaagcgcatcgagacggagctgatccggctttccgacggacgccaagctgaccttgtcgtcacaacgggcgggaccggtttttccgcgcgcgactgtacgcccgaggcaacgctcgccgtcgctacacgcaatgcgccgggcatcgccgaggcaatccgcgccgagtcggcgcgccacaccgaccgcgcgatgctcagccgcggcgcgtccgtcatccggggcggcacgctgatcgtaaaccttcccggcagcccgcgcgctgtccgcgaaagcctggcatgcatcctgccggcgctcggccacggcgtgcgtatcctcaagggcactgcctttgaatgcgcgcggccccagacgtgaccggcagccgccgctgccggataaaacccgaaaaaagccccgcgccgccctttcagggctggcgcggggcctttttttcaagatttaattccggctgctcgatgtggacgtcgggttgagaaacgggttatgtacgggcgtattcgcgctgtcatactcgttttcatgctgcggcatcgggaccgttttgcctgccccggcctgctccgcgatggacgcagcgtttgccagcatcaacttgatgcggttttcctgattgatctttgtggcgccgggatcgtaatcaaccgccacaatattcgactgcgggttgcgctccttgataacgcgcatcatccctttgccgacgatatggttcggcaggcagccgaacggctgtgtgcagacgatatttcccgcgccctgctcgatcagctcgagcatctcggcggtcagaagccagccctcgcccattttgacgccgtggctgatgtagccgcgcaccagctccaccgtatgcggaaagtatccgccgggacggaaggtgccttcggcgttgaccgcgtcgatgacgtcgcgctgttttttcaccagcatgttgtataccatgcgcagcacaaacgtcttggccgcgctcatcaggccgtagagcttgtggtcgttgagctggttatagacgcagtaaaggcaaaagtcaagcagtccggggacaacgacctccgcgccctcggacaaaaggaactcctccagattgttgttgccgagcggcgaaaacttgacatagatctccccgacgacgcccacgcggattttttcagttttctcgcgcggcagggcggcgaagtcgcggatgatcgcatcgtaattgcggcgcacacgcttataactgagcagcccgcgccccttcatctctccggtcaggcggtttgcccacttgtccacaagcgcgtccgtcgcgcctggctccaattcatacgggcggcactggttggccagcaacatcagcaggtcgccgtaattgagcgcgtaaaacacgcggtcgagcatcatcggcgtcagcttgaagccggggtttttctccatgccgttggcgctgagagacacgaccggaatatagccgtagccgcttttcatgagcgccttgcgcagcagatggatataatttgaagcccggcagccgccgcctgtctgtgtgatgagcagagcgactttgtgcaggtcgtatttgcccgactccagcgcgtcgatcatctgtccaatgacgagcagagcagggtagcaggtgtcgttatgcacgttgcgcaggccgctgtcaacgacgttctggccgctgttttccaaaagctcggccttgtatccgtattcgcgcaggatgttgatcatcagcttgaagtggatgggcagcatcgtcggcaccaggatcgtataatcgcgtttcatttcctttgtaaaaaggacgcgtccgtcattttgctcaggcatggacccgcctcctttcctcaacagcctccaggagactgcggatacggattttcaccgcgcccagatttgaaatttcatcgattttaagctgtgtatacagcttgccgccgtcctcaaggatggcgcgcacctcgtcggttgtgatggcgtcgataccgcagccgaacgacacgagctgtacaagctccatatccggctgacgcgtcacatatttggcggcgttatacagccgcgcgtgataggtccactggttgaggacgtgcacgcgcaccggctcctccaggtcggccacgcagtcctcgctgacaacggcgatatcaaacgacgcgatcagcgcgtcgatgccgtggctgatctccggatcgatgtggtacggccgtcccgccaaaacaatgatcctgcggccggcggcgcgcgcctcatcgatgacgcgccggccctcggcctttacgtcctgcatccaccggtcatacgccgcataggccgcgccggccgccgcgcgcacctcgcgctgcgtgatatccgggaacacagccgccagcgcgccgtggatcttttccgcaaatttcttcgggcggtgcacagcgacatgcggatacaaaaagtgcacgtcaggctcgtttaattccgcgacgtttgcatggagcagctcgggatagtaggcgacgaccgggcagttgaagtggttgtcgcccttttgctcgtcaaagttatatgtcatgcatggatagaagattgttttgacgccgcgctcgagcaggtccgcgatatgcccgtgcatcagcttggcggggtagcagaccgtgtcggaggggatggagaattgtcctttgatataagtttcacgtgtcgacacgccgctggtcacaacctcgaaaccgagctttgtgagaaacgcgtgccagaacggcaggttttcaagcatattcagcccgagcggcaggccgattttcccgcgcggccccggcacaggcgcaagcgagagcagcttttgcagcttccaggcgtacatgttggccggtgtcccggcggcggcgcggccgagcggacgctcgcagcggttgccggagataaatttgcgtccgcctccaaaggtgttgaccgtcaggttgcagtggttgccgcacaatccgcagacagcggaacgcgactcatgctgaaaatctttaagcgcctcggccgtgatgacggccgactgctcaagttccagctcacgcgcgtaaagcgccgcgccgaacgcgcccatcaatccggcgatctgcggacgaacaacgtcgtgtcccagctccatctcaaagctgcgcagcaccgcgtcgtttaaaaacgtgccgccctgcacgacgatgttctccccaagctccttggcggaatgggcgcggatcaccttgtagatcgcgtttttcacaaccgacatcgaaatgcccgcggagatgtcctcaacggacgcgccctccttctgcgcctgcttcaccgaagaattcataaacaccgtgcagcgcgagccaagatcgaccggatagcgcgcgaacagcccgagctttgcaaactgctcgacgtcgtagcccatcgactgtgcaaacgtgctgataaacgatccgcagcccgacgagcacgcctcgttgagcatgatcgaatcgatcgaatcgttgcgcaccttgaagcacttgatatcctggccgccgatatcgaggatgaagtcgacgtcggggttaaaaaagcgcgcggccttgaagtgggccatcgtctcgacaaggcccgcgtcgagcgtaaacgcatttttcaccaggtcctcgccgtagccggtcgccgcgccgccgcggatttgaacgcggccctcgcagcgcggcagcagcgtttccagctgcgcgcgcaccagctcgacagggttgccgcggttggcgctgtaatagtcgtagaggatgcgcccgtcctcggcgatcagcacaagctttgtcgtcgtgctgccgcaatcgacgccgagatacgccgtcccctcgtatgtatcgagatcggcgcgcccgacggacgccttcgcatggcggtttgaaaacgcggcgtagtcgtcgaggttctcaaacagcgggcgcagatggcgcgacgcgggcgtttcgttcgtcgtatcctcgattttcgccacaagctcgtcatatgtcagcggatcggcggccttttcagcatatagcgcgctgccgagtgcgacggcgtagcgtcccatatcggggaacacggcgttttcgggcgaaagcccgagcgagcgcacgaactcgcgctgcagggccttgaagaaataaagcggcccgcccaaaaagagcaccttgccggtgatgcggcgcccctgcgccaggccggtgatcgtctggtcgacgacggccttgaagatcgaggcggcgatatcctccttgcgcgcaccctggtttaaaagcggttgtatatcggattttgcaaacacgccgcagcgcgacgcgatggtatagagcttctcgctgccgagcgcgagcgtatcaagctcggcgggcgtaacgtcgagcagcgtggccatctggtcgatgaacgcgcccgtcccgccggcgcacgaaccgttcatgcgctcctcaagcccgccggtaaaaaagatgatcttcgcgtcctcgccgccaagctcgatgacgcagtcggtgtcgggcgcatacgccttgatgacttcgccggtcgcaaaaacctcctggataaacggcaggcccgccgctttggcgacgccaagccccgccgaaccggaaagcgccacgcgcaccggctggccgccgataacgtcgcgcgccatgcggatcagctccagcgtctttggccgcacctgcgacatatgacgctcatattgttgatagacgacttcgccgtcttttacgataataaccttaaccgtcgtcgaaccgatgtcgacgccgatagtcagcgggcgaacacagtccgtcctgtccatgatagagcacccctctttgaaaacccatatcgggcaaacgccgtttattctatttccagggaaataggataatggacaaaaccgcattacagcggccatttacactatcttaacacgtttgcagcacccggtcaatttgcgcctgcgcttaaattgttggcagtacgcgctgaatttgggggaatgtgcacaaatttactatactttaaaataaaaaaaatttcaacaaaaaaataccgccggggcccgccgatgtccgcagtctgcggacatcggcgggcgcacggcgtccgtcattcttttttcatcttggccgccttgataaccttcaggcgcgaaaattcctcccggtccttctcctcaagcgcgtcagtgataaaacgcgccgtctcacgatagcgcgggattacaatgttctccagagcgtttgcgcggcgctgcgtcttacggatggcgttggcaaggcgataaacgctgttttccacctcggccagcagcgccgtgacgcgctttgccttctgaaagcagacatacgcgtaatcgagacgcgaatttgtatggtcaaagccgtagcacatacggatttcgctctccgccaaccgcacattcgggatttcaacacccatgacgctgcgataggtgatcgtcacaccgtcctcgatcggcacggccatggccgtttcctgcacgatgccaagcgtgacgttcgcttcctggagcgcctcataggcgctgcggtatgtctggctgatctcgccgcgcagcgatttgacctggtcgatcagcagcatcatttcccgaatcagaatattgcgcttgcggtcgagcagatcaaagccgagcgtcgacagctccagcgatttctggatagcaatcaggctgcccttggtcggcgtgacattcaattcgttcggcatggatgtttaccccctttcccgcagaccagccggcgcgtcagacgccgaaccgcttggctgcttcatccggcttgtaaaactgctcaagcgtgttcgaagcgacgcggtcaagctcctcgcgcggcagcagcgacaagagcgcccatccgagatcgagcgtctgctcgatggaacggttctcatcaaaccgctggcagacaaaatgcttttcaaacatccgtccgaatgtcatatatttctggtcggcaggggacagttcctcctcgccgatgacagacgcgagggcgcgcgcgtcctgcacgcgcgaatacgcggcgaatagctggttggagcagtcggagtggtcggcgcgcgtgtacccttcgccgatgccgtccttcatcaggcgcgacagcgacggcagcaccgaaaccggcggatagacgcctgtctggtcaagctggcggtcgagcacgatctgcccctccgtgatgtagcccgtgaggtctggcaccgggtgcgtgatatcgtcgttgggcatcgtgagaatcggcacctgtgtgaccgaaccgccgctgccctcgatgatgcccgcgcgctcgtaaagcgacgcgaggtcggaatacagataccccggaaagcccttgcgcccggggatttcgcccttggaggagctgaactcgcgcagcgcctcgcagtaggcggtgatatcggtcatgatgaccagcacgtgcatcccgcgctcaaacgcaaggtattccgccacagtcagcgcacagcgcggcgtcaggatgcgctcgataatcggatcgtttgacaggtttaaaaacatgacaacccggtccatcacgccgctgtcctcaaacgaccggcggaaatagtcggcaatatcgtttttaacgcccatcgccgcgaacacaatcacaaaattgtcggcgcccagcccggaaaggcgcgcctggcgcaccatctgcacggcgagcttattgtgattcatgccggagcctgagaagataggcagcttttgccctcggatcagcgtggctagcccgtcgattgacgagatgcccgtgttgatatagttgcgcgggtaaacgcgctccaccggattcatcggcatcccgttgatatccgcggactgttcgcagaacagctcgccaagcccgtcgattggacggccggagcctgaaaaggtgcgtccgagcacttcgggcgaaagcggcatctccatcggatggccaagcagcgttgtctttgtattttccagcgacatgccgcgcgtaccctcaaacacctgaatcacggcgcgcccgcccatcagctccacaatgcggccaaagcgcgtttctccgcttgtcaggcgcagcgaaaccatctcctcaaacgaggcggacggcacgccgtccagtacaaccagcgggccgttgatctcatgaagccctacaaactgtaacatccatccgcctcccttcaaagcatctgcgcgagcttggcgatgcggtcgtcgatctcgcggtaatagctgtcgaacaggtcaaggcggtcgttgggcacatcgtatttgatcttgaccagcttgtcgggcagacccgtttccataatttcggagacgggcagacccttttcaacaaccgctttggccttatcgtaaaaatagaggatgacctccatcatcttcatctgcttgggcagcggcacataggtgtcgtcgcggtggtaggcgttttgctggagcaggccgacgcggatgatgcgcgcggcctccagcacaagcttctggtcgtcgggcagcacgtcctcgccgatcagcttgacaatctccatcagcttgttttcctcaagcagcaatgttgaaacgcgctgcctgcgcgccagaaaatcgggcgaaatatgttttgcataccacggcgcgaggtcgtcgaggtattcgctgtagcttgtcgtccagttgatggccggataatggcgcgcgtaggcgagcgccttgtcaagcgcccagaagcagcggacaaaccgctttgtattctgcgtgactggctcggaaaagtcggcgccctgcggtgaaaccgcgccgataatcgtgacggaaccttcggcgccgcaaagcgtctgcatatagccggcgcgctcgtaaaactgcgaaatacggctcgagagataggccgggaaaccctcctcggcaggcatttcctccagccgcccggaaatctcgcgcagggcctccgcccagcgcgacgtggaatcggccatgatcgcgacatgatagcccatatcgcggtaatactccgcgagcgtgatgcctgtatagatcgacgcctcgcgcgccgcgaccggcatgttcgacgtgtttgcgatcagcacggtgcggtcggtcagcggttttttgctctttgggtcctcaagctcgccgaattccttgagcacctgcgtcatctcgttgccgcgctcgccgcagccgatgtacacaatgatgtccgcatcgctccacttggcgagctggtgctgcgtcatcgtcttgcccgtcccaaagccgccggggatcgcggccgtgccgcccttggcgacagggaacagcgtatcgatgacgcgctgcccggtgatgagcggccggtcgatcggcaggcggcgcgccacgggacgcggctcacggatcggccagaactgcgtaagcgaaagcggatgcgcctgcccttcgtcgtcctgaagcgtcagcagcgcttcgccggccgtatacgcgccgtccggcctgacatccacggccgtcccggaaagccccggcggcaccattgcgcggtgctcaatgatcgacgtttcgggacaaaccgcgaaaatctggccgcctgtcagccggtcgccctcccggacgcgcatggcaacgtcccattttttctgcatatcgagcgccggcaaatcgccgcccgccgggatgaacgcgccgtttgcggcggcgatttcgcgcagcgggcgttcgatgccgtcaaagatgtttgaaaggatacccggcccgagcgccgcgcacatcggcccgcctgttccctcgaccggttcgccggggcgcatgccggtggttccctcataaacctggatggtcgtctcgccgctgccgacgctgataacctcgccgatcaggcgcttatggccgacaagcaccttttcctgcatttgcagcgcgccggcctccttgaccttaacgaccggcccgttgatggaataaaccgtattctgcgccatcggcgatcacccctgtccttcctgtgcggagacgtcctccagcataaaattggagttatggtaaaaccagtccttctgctgtgcgagcgccgaaccaaggctcaaatcgatctcgacgccgcgcgccttgttgaccagcacaacgccgccgaccggcacagccgcgtcgtcggcttcgactgcacagccgggatacagcttgcggatatcggattcaaagcgcaggtcgtcggcacgcaccttgatcacgctgccctccatcggccagtcatgcgcgagcgagcggacctgccccagcaaaaactccctgtacgcgccgcttttgcaaaacgaggccagctcgacgcgcgcctcggcaagcagctccgagagatactgctcccgctgccggtacagcgcatgcttcatctgctgcgtttcatgggcgatctcgccggcagtgtcctttcgaatctgcgcgacctgtgcctggatatcgttatacaattcgtcataaaggcgcgccttttcctgttccagcgcctcgtccttcatccgctgcgtttcagcgcgaatcgcctcgctttcagcctgtacgcggttcatgatctcccgctcgaaatattccagcttttcggactgtatatctgacatggcctgtcacctcccgttggcagcgcggcttacagcttgacaccgatggcctcactcacatatttttcgatggtctgcgacacatccccttcgccatgccggtcgggaatttcgacgatcagcgggcgtttctgcgtcagcttatagcggtacaccatagcgggacaggtatcaatcaacttttccgtcatcagcacaatgccgatttccgaatcagccatcacgcgccgcagcgccgcgagcacctcgtcctgcgtatggatcacctcgccctcgatcccggcaagccgcatccccatcatggtgtcaatattatcgctcaaggtataaaatttcataagcacctttccccgcttttttaaaaaaagcttggcaaaaaactttccggcctttttgaaaaaaggcctcggcgaaaaacttcataccttttttgaaaaaaaggtatgccaaaaaactttagtcggctgcgccgcgaatagtgggttgagtactgcgtcaataccggctgcgccgcagacgcaaagcattccggcgcgcggcttacagcttattgatcagcaggatggagatcaaaagcccgtagagcgcgacgccttcgcccagcacgacgaagatcagcgccttgccgaacgccttggggtcctcggaaaacgcgccgatggccgccggggcagtggacgcgatcgcaatgcccgcgcccagacacgaaaggcccgtggccagcgcagccgccaaaaagcccatgccctggccggcgtctgaagctgtggctgtggcggcggccgcagcttcaggcgcttcggcggcggccccgaccgccataacgaccatcagcgcggcggcaacaacaaacaagcccgcattcataacaaggcggcggcgcgcgcggcccgtatcacggttttttctggcggggagcagcagcaggagcgcggcgatgaccgcagcggttggaatcagatacagcatattgatgaacctccatacattcatttgctttcatccggcgtcacggcggcggggacaaacggtttcccatcgccgtcaaaataccggctgaacaattcataaaactccagacggagcacctgaatgccgacaatcaggccctccataccgatgacaaacagattgccggccacgatgacaatcgggcttgccgcgccgctgaccatctcagacagcgtaaatacgacggccatcatgcccgcatggctcaatacaaagcctccgacgcgcagaaacgacatcgtgttggaaaagaagcttaaaaccacctcaaacaattcaaacgcgccttccgtcagatacgcgcccattccctcagccgggcgggcggccatatgacggacgatttttcccagcggctccttgaacaggattgccgcaagcggcagcacaatcagcaggacaacgtaaagcggcgtaaacaggtttttgccggttataaacagcatggccgcgccgaacagaatagagccgtaaaacagcagccccgcaatgccgtttgcagaaaatacagcactttcataatcatgacgccggaagccggtccaaatgccgatcagaatggaaatgcagatcagcgccacgccgagcgcgacagcagtcaaaagcacaaggttggtgttttcaggggccataacctcaatcggctttccaggcaggccgagcacctgcgtataaaagggcgtcaacagctcctcaaagccgaatacagaaccgtaaagcgccccgaaaatgcaggaaaaaataccgatgcggttgattatgcgtccaagcacagcgcccttcatgcgccagaacagccatccgccgaacaccagcaaaagtccctggcccagatcgccgaacatcgcgccgaacaacaggcagtaggtgattgcgacaaacggcgtcgggtccgggtcaccgtaggccggtacgccgtacatctcgacaaacagctcaaacggcttggcaaaccatccgtttttcagctttgtcgggaccttcaggcgcttgtctgaatcatgcggccggatttcaacatccactccgtcgagcttttttattcccgcggcaaacgcggccgcgcggtcctgttcgatgaagccggtcagataaaacacgtcgatatattcgcgccgcagcacggacacgaagcgccgcagctcaaacgaatccgacagaaaccggatccgcgagtagatgcgcgtaaattccgcgttgttttcgcccaccacatccgcgagctgcttttttgtctgcgccagcgcgtcgcggttgcgcgcgatttgctcgcgcaggcgctcaagcgccgcctccggcgtcccatggatgaattcgggcacgcgcacccgttcaaagtaaagcgataaaaacaggtcgtcgatctccggggcgttttctgtcagaacaaaataggccccccattggtaatcgccctctatatcaaacgatttaaatataaacggacgttcggcataatactcgagcttgcgcaccccgtcgagcggaaggcggccaaaacgcacctttgtatatttgcaggaaaaaaggtcgtcgaacgccacgtcaagctccgccaggtgcgaaaggatcacaagccccgattcatcctgctcgatctcgctgtgcagatagttctgccgctcgcgcagcgccgtcgtcttttcccggaaggcggagcagaaatcctcgcagtagcgcgcctgaagcgcctcgcccgcagcccccggatcgtaatgcggcgtcagcccggcggcgacgcccgcgtcggtaattttagcgagcaaaggcccatatggattttcttccgcgagcggtgtaaagccccggattcccccggcggcctgcaaaggcggctcggggtgaaaggccccgctgcccagacattgcatgatcacgtcgtccaactgcccgaggtcgcccgcaatactcacgagcgccatttttgcaatggccatgaccagcctccatttctccggtcgtcccggtaattctttcaaagcccgaataaatacagaaaagagattgtttcaggccgctcctgcgcggctctcaggatcgcgcaagcatggcgccgatccgttcgggcggcagccggtagcgcacgccctcgatgatacggatgatgtcctccgtctccatcgcacgcagcagcataaacgccaaataaaccacctgcggttctgtggcgaaacgcagcgtccgcagcgtttcgtgataacggacgcgttccgtttccagctctatgaaggccgcctgcgaattgatctgacgcccaagcgcggtctgcgaaagcagcttcataaaggtctgcgtgtccttcgcctcgatcatcgcctgcatctgacgcgggcggatacgccagtgataggggagcagcgtcgcgcggatgcgccctgcgtcggcattgaaatacgttttcatgcggaagatcgtgttgaggttcatcagctccgcacgcatcctgatcagccccgaaagctgttttgccgcgtgcttcggcgcgcgtgcggcgcgtaaaagcatcgactcgaaatagtatgtgcgcagcgccacctcgtaccgggtgaagcgcagcgaaccgccctgcggcgggtactgctcgcggcaggcgcgcaggatcgcctcatacggcgtcgcccgcacagcctcgatcagtccgtcgagcgttttcgcctgcgccagcgccaccaaatcaaagcgcgcgtagctctgcataaagctcggcagagccgccaacaggtcgccgctgcccgaaatgataacgcgcagagccgacagaatcagctcgatctccatatccggcacaatatagccatagatggcgccggcgcccgcgccgggcacataatgcgtcagccgcgcgtactggtaaaacaagtcgcgccgcaaaagcgtctccaggcggccgcgatggatcgcgctgtcctgcacgccctcgagcgcctgcgcgtaagcggtgtgctcgcgcagataggcggaaatctcctgcacgctctgcttgcgcagcaattcatcgtattggctggacgtcagcatccgcccaaaggccgcgcgcgccttggcggcgaccgcgttttcactgtgccgcatcgccgtcacctgccgatgcagcggccgacgatctgacgcagccactcgtcatggcgcgccgtgtagacgcggcgcagcgcctgcatccgctgctcattctttgcgcgcagcccggcgagggcttcgtcccggtccctctgggcctgctggcggacctgctcgacacgctcggccgcgtgcgcgcgcatctgccgctgtatcgcgcgcttatcttcatccaggcgcgccagcgtttcgaggcgggcctgctgcgcctgccgcacaagctcgcgtcccctattgtcatattccacgagcagcttgatgacccgctccattgcatatccccctttgcagtgaaaaaattcgaattcttacccattttaattttatccagtgtaatccgtttctttttgatttgcaagcattttcaaaacagatttcacgcttttttgaattcctacgcatgatttacaaattttcacctctgtttttgtctattttatcagattacgccaagaaccattcgtttcgctggaatataatttggctcccgccggaaaattgcctgccaattgcttgattttcattatactgtttgttataattattatacatatagatataggaacccagcgtgcggctctgcaccgcgcgccgccagagagggaggaacgcaaatcatgaaaaaactggtgggtatgatcagcctgctgcttgcctgtgtgacaatcctcaccgtgcctgtttcggcggtggcgatcatcacgggggacagcttcggcaaaacgtcaaacaaaccctgggaggttgaccgctacgctccggacgagtttgacacaagcgaaaacgaactgtatatcaccgtcggcccaaagggctttacaaccgcgcgcccggcagacaagcaggataaatactatgctgtgcagggcaaaaagctcgcggcggcccagacctcgtcgaacacatggactgcgactgtcaagatcaatgttgatgacaactggttctcatcgagcagcaacaaccgccgcgccgagtttcgcgtcgatctcaaggatggctccggcaacgcgatcagcgagtctccaacgctcgcgctccagaagatgggcagcaaggcgccatatatcgtctattacacctcaaagtcgaaaaccggctggagccaggcgcgcaccttcgtcaacggcgacaaggaaattgagtatcttgaagtcgagccgggctggaacagcctgctgatcaagtgcgacaagggcgtcatctcctattacctcaacgaaaagaaacttggcaactgcacgctttccacaaatcagaaggacgtatatccgtcgtatttggcgctcggcgtctataactacaaccgcaccgacaccgtttcgttcgacaacctctacctctacgacggcagctatgtcatgcgccagctttcttccgaagcgcaggatgaacgggacgagcggctggaatcgcagtatgagaaaaaacgcaacagctgggaggacaaatatactgaatacatgtttaaccgcgattccgacgaggacgtttacctgaacggcaggaaggttctggagggcggcaagtggtataagcagagtacggtcaagagtaagctcaaagtgtccgacaaggatttcgatgttgaatatgacctgctgatggaaaagatcgatcagctcaccaccaaggacggcggctcagttgaatatgagacgcgtgaaaccaaggatatgcctgatgattactgggactattgattcccacttactcctttccagaacggcggatgcaggtgcatccgccgttcctttttattccgaatattgggaaaagtcaacaaaattttgcgccctttcttgacaagatgccgacttggtactatgataacgtcgtatgagtatcgttaaatcagggaaaaagggagcagccacaaatgaaaatcaaacgcggcgatttaagaaatattgcaatcatcgcacacgtcgaccacggcaagacgacgcttgtggacggcatgctcaagcagagcggaaccttccgtgaaaatcaggccgtgcaggagcgcgtcatggactccaacgatattgaacgcgagcgcggcattaccatcctggcaaagaatgcgtccgccgaatataagggcgtcaagatcaatattgtcgatacgccaggacacgccgacttcggcggcgaagtggagcgcgtgctcaaaatggtcgacggcgtattgctgctcgtcgacgcggccgaaggacccatgccgcagacacgctttgttttaagcaaggcgctcgacctcgatctgggcgtcatcatcgtcatcaataagatcgaccggcccgacgcgcgtgtctatgaggtcgttgacgaggtgcttgaacttttaatggatctgggcgcttcggacgaacagcttgacagcccaatggtgttctgctccggccgcgacggcaccgcttcgtattcgccggaaacgcagggcgtcgatcttcagccgttgatggatacaatcgtcgattatatccatgcgcccgagggcgacccggatgaaccgacggcggtgctcgtctcgtcgatcgattacaacgaatatgtcggacgtatcgcaatcgggcgtattgaacagggcgaactgaaggtaaacgcgcctgtcaccgtctgcgattaccacgataaggacctgttaaaacagggcaaaattacagctatctaccagttcacaggcgtcggacgcacacaggtgcagtcggctacagtcggcgatatcgtcatgttctcgggtattgaggatatcaatatcggaaatacggtttgtgccgccggttcgcatatcgcgctgccgtttgtaaaaatttccgaaccgacggttgaaatgaccttttcggtcaatacaagcccgttcgcgggacgcgagggcaaatttgttacgacgcgtcagatccgcgaccgcctctatcgcgagctgctgcgcgacgtatctttgcgcgtaaacgacggcgatacagccgactcgtttattgtctgcggccgcggcgaaatgcatctttcaattttgattgaaaacatgcgccgtgaagggtatgaattccaggtcagcacgcccaaggtgctctataagacaatcgacggcgaacagtgcgagccgttcgaggagctgaccatcgacgtcccggccgaatattccggcgctgtcatggaaaagatgggtccgcgcaagggcgaattgcagtcgatggacccggtcggcagccgcatgaaaatggtgttcatcatcccggagcgcggcctgttcggctataagagcgaatttctcaccgacacaaagggcgagggcgtcatgaatacgctgttttatggttacgcgccgtacaagggcgaaattccgcgccggcaaaatggttctctgatcgcgtttgaaacgggcgaaacgatcacctacggcctgtacaacgcccaggagcgcggcacgctgtttctcggcgcgggcgagccagtctatgctggtcaggttgtgggcatgtcgccaaaaaatgaggatatcgcggtcaacgtctgtaaacgcaagcagcttacaaacacgcgtgcctcaggttcggacgatgcgctgcgcctgattccgccgcgccggttctcactggaggaggcgctcgaattcatcggcgacgacgagctgcttgaggtcacgccgaaaaatatccgtatccgcaaaaccatccttgaccattcgcagcgtatgcgcgagcagatgaaaaagaaataacaggcacgggggaagggcgtatgaaaagatgggcggtacgtttcagccttctgcttggatacacggtcccgtatctctatttatccatgtacatcgatttaacctatggaacccctcttttttacgccgcagccctgatttgttatgtcatcctgtatctgctggcaggcaaaacgcataaccgccctgccgcactcatcggaacggtttggactgccgtttcttcgtactgcttcatgcagcatggctggacgcaggactgggaatggtattttaagccccttacggccacgcagcttttgatagcgctgtccgcggccgccctttttatccagcttttggccatacgggccgctgaaaaaaagaaaccgtgaaaaaccaggccgccgcgcgtttgcgcggcggcctcttttttgacttctggttctttattatggcgcggcctatttttacgcagcgccaaacccactgttcgcggcgcaaaactaattacgcagggcctgccccactgtttgcggcacagccgattaaagttttttgccgaggcttttttcaaaaaagccggaaagtttttttcaaaagggctggagcaaaatccgcgtccagccgcacagcgtctgtcacggattttgcttggggcaggcggctacgcctgaacgggtgtcttgcggcctgcgggccgcgcttttatgagggctgcggcccgggttcagggctccgccctcgaaaaaaggcaagacccacgaggggccttgccttttttctcacccgccgccttttgaaaaaggcgggcgaaaacttttgatcgacgcggcgtaaaagccgattacgaagcgcctgccccactattcgcggcacagccgattaaagttttttgccgaggctttttttcaaaaaagccggaaagttttttgccgggctttttttcagaaaagcggggcgttacttgagggcttcttcgacggcgacggcgcaggcgacggtcgcgccgaccatcgggttgttgcccatgccgatgagccccatcatctcgacgtgcgccgggacagaggacgaaccggcaaactgcgcgtcgccgtgcatacggcccatggaatcggtcaggccgtaggaagccgggccggcggccatattgtccgggtggagcgtgcggcccgtgccgccgccggatgcaaccgagaaatatttgacgccgttctcatacgaccatttcttatatgtgccggcaaccaggtgctggaaacgcgtcgggtttgtcgagttacccgtgatggaaacgtcgactttttcgtgcttcataatggcgacgccctcgagcacatcgttggcgccatagaccttaaccttggagcgctcgccgtcggaatacggcgtctcgccgagaaccttcagctcgcttgtggcaaaatcgtagtcggtctgggcatacgtaaaaccgttgatgcgggaaataatataggcggcgtccttgccaaggccgttgaggatgacgcgcagcggctctttgcgggccttgttggcgttgcgggcgataccgatcgcgccttcagcggcggcaaacgactcgtggccggcgaggaagcagaagcactttgtctcgtcgcgcaggagcatcgcgccgagatttccgtgaccgagtccgacggaacgtgtttcagcgacagaacccgggacacagaacgcctgcaggccgatgccgatggcctcggaggcgtcggcggcctttttgcagcccttcttgagcgcgacagcaacgccgagcgtatacgcccagacagcgttttcaaacgcgatgggctgcacgcccttcacgattttttcaacatcaatgcccttatcaagacagacggcgcgcgcatcctcaagggaagacatgccgtattccgccaggcacgcgttgatcttgggcattcttctttcctgtccttcaaacttaaccatgttgttacctccctctccttttattcctcacgcggatcgatatacttcggcgcgtcggcatagcggccgtaggtaccgatgttcttttcatacgcttccttcgggtcgacgccgtgacggatgtcctcgagcatcttgccgacgcggacaaacttgtagccgatggcctcgttgttgttgtccaccgcgacggagaggatatagccctcggccagctccagatagcgaacgcccttggcgttggtggagaagatggtgccgacctgcgaacgcaggcccttgcccagatcctcaagcccagcgccgatgggcaggccgccctcggagaacgcggtctggctgcggccatagacgatctgcaaaaacagctcgcgcatcgcaacgttgatcgcatcgcagaccaggtcggtgttgagcgcctccaggatcgtcttgcccggcaggatttcaccggccatcgccgccgaatgcgtcataccggaacagccgagcgtctcaacgagcgcctcctcgatgataccctctttgatgttcagcgtcagcttacacgcgccctgctgtggggcgcaccagcccacgccgtgcgtcaagccggaaatgtccttgatttcataagccttgacccatttgccctcttccgggatcggggcggggccatgcttggggcctttggcgagaacacacattctctccacttcatgggaatagttcatatcggtgctcctttcggttttttaaaacgggttgtccatctcttattataggcatttcaccgcgcgcacgcaaggggatttgttcagcttttgttaattcttggacaacaatttcgtcctgatttcgggcgattttttgtatataataaagatatccgtctgcgcgcggccgcaaacgtttaaaaacactggaatctgttgacattgacggcggctgggagtaaactatataagttgaattgtgcgcaaatgcaaaggcgcccgcgcgcgaagggaatctgtgaagcggaccaaataaacgacgtttctttgcgctgccagggtcgggaatataggatgaggtgacaaaatgggtctgattaaaaaactgttcggaagctattccgagcgagagttaaagcgcgtttatccgatccagcaaaaggttcttgcgctggaagaaacatataaggccaaaagcgacgccgagctgaaggctgtgacgccggcgcttaaagaacgcctggcaaacggcgagacgctcgacgatattctgccggacgcgttcgctgtctgccgcgaggcgagcgaccgcgtgcttgggatgcgccatttcccagtgcaggtcatcggcggcatcatccttcatcaggggcgtatctccgagatgcgcaccggcgaaggaaagacgcttgtcgccacgctgcccgcttatctcaacgccctgaccggcaagggcgtgcacatcgtcaccgtcaacgattatctggccaagcgcgactccgagtggatgggcaaggtctaccgtttcctcggcctgtcggtcggtctgattatccacggccttgatacgcagcagcggcgcgacgcctacgcctgcgatatcacctatgggaccaacaacgagttcggctttgattacctgcgcgataacatggtcatctacaagcgcgacaaggtgcagcgcggccacaactacgccatcgttgacgaggtggactccatcctgatcgacgaggcgcgcacgccgctgattatctccggccagggcgacaagtcgaccgacctttatgagcgcgccgaccgctttgcacgcacgctcaaatgctaccgcgtcgccgagacggactccaaagaggagcatgacgacgtcgacggcgattatatcgtcgatgaaaaagccaaaacagtcacgctgaccgcctccggcgtcacaaaggcggaggaatatttcggtgtggaaaacctgaccgacggcgacaatatgcagctccagcaccacatcaaccaggccatccgcgcccacggcatcatgcagcgcgacgtggactatgtcgttaaggacggcgaagtcattatcgtcgacgaatacaccggccgcctgatgctcggccgccgctataacgaggggctgcaccaggccatcgaggccaaggagggcgtcaaggtcgagcgcgagagcaaaacgctcgcgaccgtcactttccaaaactttttccgtatgtacgacaagctcgccggtatgaccggtacggcgatgaccgaggccgacgagtttatggagatctataagctcgacgtcatcgaaatcccgacgaacaagcccgtccagcgcgtcgaccaccacgacgttgtttacaagactgaaaaagcgaaattcaacgcggtcattgaaaacattgtcgaatgtcacgaaaagggacagcctgttctggtcggtacgatttcaatcgaaaagtcggagctgctctccgggatgctcaagcgccgcggcatcaggcacgaggtgctcaacgccaaataccacgagaaggaagctgagatcgtcgcacaggccggccagtacggcgcggtcacaatcgcaacgaacatggccggacgcggtaccgatatcatgctcggcggcaacgcggaatatatggccaaggcacagttgcgcaaggccggttatgacgacgaggtgatcagcgaggcgacgggctttgccgacacggacgacgagcaggtaagcgaggcgcgccagatgttccgcgagctgatggatcagtaccgcgctgaaatttccgttgaagcggagaaggtgcgcgcggctggcggcctgtttatcatcggtacggagcgccacgaatcccgccgcatcgacaaccagctccgcggccgcgcaggccgccagggagatccgggcgagacgcgctttttcatgtcgctggaggacgacctgatgcgtctgttcggcggcgagcgcatccagaatatgatgaacatgattggcgccgacgacgatatgccgatcgaagcgaagattctgaccaactcgattgaatcggcgcaggcaaaggttgaggcgcgtaacttcggcatccgtaaaaacgtcctccagttcgacgacgttatgaaccgccagcgcgaaattatctattcacagcgcgacaaggtgcttgacggcgaggatatcagcggcatcatcaagaacatgatcaaggagacgatcgattccaccgttgaccgttatcttgttgataaagaggtccatgacaactggaatctcgagggcttgcgcgactacttcctcggctggctgacaacgcaggaggatctgcgctacacgaccgaacagctcggcgaggtgacagaccagcagatcaaggatatgctcaacgaccgcgctgaaaagatctatgcagcgcgcgaggcgcagttcaccccgccgatcacgcgcgagatcgagcgcgtcgtgctgctgcgcaatgtcgatatgaagtggatgcagcacatcgacgacatggaggaactcaaacgcggcatgcacctgcgcggctacgcgcagaaggacccggttgtcgaataccgtatcgagggctttgacatgttcgacgcaatgatcgaatcgatccgcgaggacacggtcaagatgatgtttacaatccgcctgcgcactaacgaggagccaaagcgcgagcaggttgccaagcccgctcaggagagccgcggcgaaagcgacggcacgcttgaaaaccgtccccgcaccgtcaaaaaggtcgggcgaaacgatccctgtccctgcggaagcggcaagaagtacaagaagtgctgcggccgcgacgccgaataacccccagcctttttgaaaaaaggcttcggcgaaaaactttagtcggctgcgctccagcctttttgaaaaaaggcttcggcgaaaaacttagtcggctgcgctccggcctttttgaaaaaaggcctcggcgaaaaactttaatcggctgcgccgcgaacagaaagattagcgcatcgtaatcaaaagttttcgcccgcctttttcaaaaggcggcgggtgagaaaaaaggcaaggcccctcgcgggtcttgccttttttcgagggcagcgccctttccccgggccgcagccctcataatagcgcggccctcaggccgcaagagcctgttcagacgcagggtcttccgccagcaggaggcgtgccagacgccgcgcggctggcgcgatctcctgcaagctttcaccgttttgggagaacgccgctctgtttttccctccgtccattctaacgccaaaacgccctgtaccgccgtctgccggccgatacggagcgtttctttatcttcgtttatggctgatgcgccgggcaccttacgattttggcgggcaatagggcaggtcccactttgaaacttccaacccctttgcgcgcacggcgtcgatcaattctccaagaatagaagcgttgtcgctgctgaccgcgtgcagcagataaatcgctccttcatggataaacttttccgtataggcgagcgccgcgtcatggccacgctgatcgttggggtcataatccttataagcaaaactccacagacaagtcgtatagccaaggctctgcgccatcgcgagcgtctgttcgctgaaggcgccttcgggcggacgatagagcgtcatctcgtagccgaagttttccagcacatagttgtgaagctcgcggatatcctcggccgcatcatcaatcgatttggacgttggattccagtgatggcttgtgtggttgcccacaacatggccttcgtcgatcatgcgctgcacaagctcaggacacgactgcacatacggcagcgtcacaaaaaagacggcgctgcaatttttctccttgagcacatcgaggatttcctctgtataaccgttttcatagccttcatcaaacgttaagtaaaatttgccacagtcgtccggcgcaataaaccaggcgctgtattctccatattgctcctgcaagccgatcggagcgatcgtccggtttgcctcgtctacctgcacgcctggcccccacttgatctggctgccgcccagagcaccgattttgtcaaaatcggtgctcatggtcggcgttaccatactggccacgccggaacggatgtcgctcgtcacatctccaagatcggaggcaaggccatgcgaagccgcagaattcggtgtggacggggtagacggcgtcgacggtgtggacggagccacagacgcggccgacgacgaatgcgcaacgctcgacgactgcatattatcctgattgcgggacgtacatgcggccatggaaacgaccagcgcaagcgtcaaagccgccgcgaaaatcgctttgatagctttcattggatttcttcctttcacaattaaactgggaaaccaagaaatacagcttgaaataacatggttacttcggtgttagtgtgtgcagaaaatgaaaaattactactttggataatcggtataaatttccaagttataatgttttcctatatagagtgcgctgaatgattcattttcaggcacttctctactatttttacagaagcgaattggccatgccggttacaaaaccggcatggccaattttaaggccttgttttcagttttgattgccacgccggcgcagggcgtcatatttaagaattccaagctgcgtctttgcatctggaatctcaccgtcgagcaccatctgcaccgctttttccacaggaatgcgccggacagttaaaaactcatcttcgtcaagatgctgccgcgactgatgaaggccggtcgctagaaaaatatgtatgatttccgtatcgtaagcacaagttggatacatcctcgcaagcggtacaaaacagtccgccttgcatccgcattcctccgataattcgcgcacgccgcattcctgcgggttctccccgcgctccagcttgccggccggcaattcgagcatgacgccgccgaacggataacgaaactgtgatacaaacaaaatatgctcatgctcatcgatagccaaaaccgccacgccgcccggatgatcaatcacctcgcgcgccgcgtgatttccattttccagttctactgtgtcgcggcgcagcgtgagaatttttccctcataaatcaccttggaatcgattgttttttcataatgagccaatttggcaacccccttgctcatcccgccttgctgccgggaactgagtttgcatgtccgcctcaaatcccctttttttgtgccgaactgccataatacaagcgttttggcacatacactgggcttagaggtgaaacaatatgtttgacggattttacaaacagccgccccgctttgagcatatccggcaggcagtgtgcgctctgcgcgatgaatacccgtttatacatgccttcccgattggcaaatccgtacttggccgcgggctttatgcgcttggttttggcaaaggcggcagcggcgcgctgcttgtcggcggcgtacacggaatggagtggctgacaaccatgctgctgctgcgcttcgccgaggatgccgcacgcgccatatcaacatgcgagccgttggctgacattgatctgacccatacccttgaaaaccggccatttacactcatcccgtgcctcaaccccgacggcatggaaatttcacttggcggcgccggcacagcgggccatttacaggcgtttgtagaaaaagcaagcggcggcgacacgctgcattggcaggccaacgcacgcggaatagaccttaaccacaattttgacgccggttttgaacaggtcaaaaagcttgaacgggcggccggtattgatgcgcccggtccaacacgctacgggggccacacgccccacagcgaaccggaaacacgcgcgcttgtcaacttttgcgccgccttcagaccgcgtactgcctatgcgttccattcccagggagaagaaatctattaccgctatggtccgcatacgcccgccagaagtcagcttatggcgcaggtcctcgcttcctcatgcggttaccggctggcgtcgccggagggaactgcttcgcatggcgggtttaaagactggtttattgattgtatgcggcgtcccgggttcacattcgaaatcggccgcggtaaaaacccgcttcccattcaggaatttgaaccaatttatgcgcgtctggtcgagacgcttttgatagcgacgcttctttaatccataaacgccttcccgctgcggcacataaaggatttttatagattgctgtgcaatctataaaaatagttgcaaagcaactatcttggcaaaattgtccccgccatgggcaagtatatttgattgatctggacctgacgcgcatggagccggcgatctatttttatattatactgctattggacaaaaaatacaatagatcaaaaagagcttgtcctcgctttggacatctatacaaatgcgcgccttaagcggaaaaggcactcaaaccggcaaaaaagggactatacaaacattcccgtttccgatataatgaaattatatagcgtaaaaagtgtataaaattcaagaaaaatgaagtggtgaacagcttggatatttttatgatcatcagtatgttaggcggcctggcaatgttcctttatggtatgacactgcttggcagcggtcttgaaaaaacctccggcggccgtttggaacgaacgcttgagaagctgacggatacggtgatcaagggcgtgctgctcggcgcgcttgttaccgctgccatccagtcctcctctgcgacaactgttatcgttgtaggtcttgttaatgcacgggttctcaaactgcgcaacgccatcggcgtgatcatgggcgctaacatcggtaccacggttacagctcatatcctgcgcctgtccgatctcgattcctccaacctttttttccgctttctcaagccgacaacgcttgcgccgttggcctgtattgtcggtatccttttgattatgacggccaaacgcaacaaggcccgcgatataggctccattttcattgggttcggtatcctctttactggtatgtttacgatggaatcgtccgttaagccgctcgcggagctgccgcagttttccgcggcctttgctgcgatgggcaacattcctctgctcggtgtgctcgtcggtgcaggcgtcacggcgcttatccagtcgtcgtcggcgtccatcggtattttgcaggcgctctcctcgacaggacagattaccttcggcatggcctttcccatcatcatggggcaaaatatcggtacgacgatcacccctattctcgcctcgatcggcgcgaccaaaaacgcaaagcgttccgcctgtgtacatgtgaccttcaatgtgttgggcacgatcctgttttttacctgcggctatgcgctccagtctatccttcattttgccttctgggatttgccggtcgataaaggtatgatcgctaatttccatacgatattcaatctcaccgttaccattctctttataccgtttgtcggagttctcgaacggattgcctgcaccattgtgaaggataagccaggtcaaggtgaacaggaaatcaccgcagcctcgcttgatgaacgcctgcttgtatctcccggccttgcgcttgagcatgtgcgcggcgccgttgtacagatggcgttgcttgctcgctccaattttcttgattccgtcgcgctgctcgatcgctatgatcaaaaaatagccgatcggatacaggaaaatgaggatgttgtcgataagctggaggaccgtgttgaaacgtatctgctcaagcttggcgaacgcgagctgtctgaaagtgaaaaccgcagcatatccgagctgctgcacacatgcggcgaatttgagcgcattgcagaccacgcacagaatattgcagaatgcgccgaccgcatggtcgatacaaagacgactttttccaaaaaggcgacagaggaaatgcatacgatcagcgaggcagtccatgaaatcctcgatcttgcggtcgatgctttccagaatgtcaaccgcactgccgccgccaatatcgcgccgctcgaggaggttgtcgacgagcttgaacaaatgctaaaggacaagcatatcgaccgtctgcgccgtggaaaatgcaccgtcgacgctgctttcccgtatgttgaggcgctctccaacattgagcgcatctccgacctctgttcaaatgtgggtgaatctgtactgacctatgacagctcacttgttgaaatcgaccgccacgcttacaaacggttgcgcgctgaccagcatgataccggttatcaggataagtatattgtttacagtacgaaatattttggaaaggtaaaacggacgcaggacaaataatggatatccgtcgccccgtctatttcttttctcctcccttgcggggcacggttcgccgggttttccggcataaggggttaatcttctcttttttgataatcaggcgatcaactgcattccatctgttctttttgcctctgaacggaaaagggctgttgtcattgtgaaagcgatcaaaaatgaggtgagtatatggatcaggaggaccatatctgtaaaaactgtgcatatttcaggcagcattatgtcaaactgggttggagctaccgtgaaattaaattcggtcactgtgtttacccgcggctgaaaattcgtgaagcaggcgccaaggcctgcacgcattataagcagcgggagcatactacctctgccacaacataaaaacggccccttttggggccgttttttttcctttatctatcctctgccgttttgtcagtttcgccggctgcttcgtcccccgcggcgatttgtgattcctcctgcccgtcatccccggaagtctcctccttgggagcgcgcgccagggtcacaacccggctttcctcggatacgcgcattgcgcgcaccccgccgccatagcgcgactgtacagtgatctcacgcacaggaatacggatgataacgccatcgtcggtgatgataatcacatcgtcatcctcgtcgaccatgcgcacacctgcaaccggcccgttcttatcgacataatagttgcggattcccttgccgccgcggctttgcagacggtactgcgacacttctgtacgccggcccagaccgctttcggagacagtcagcagcgtcgcgccgctttccttcctgacacgcgccataccgacgacttcgtcgccgtcctccagcgtgatcgccttgacgccgcgcgctgtacgcgacaacggccgtgcgtcctgctcatcgaaacggatcgccataccgtttttcgttgcgataatcagttcgcttgtaccgtccgtctgacgcacccacgccagctcgtcgccatcgtcaagtccaattgcaatcagtcccatacgccgcacatttttatacgcgcccagcggcgttcgtttaataatccccttgcgcgtcaccataacaaggcagcgatcctcacgctcatattcgtcaggcgtcaccttaataagagccgttaccttttcgtcgctgtccatcgaaaggagattgacaatatttgttccgcgtgatgtacgcgacccttcgctgatttcatagcccttaaggcggaagcaccgtcccttgcttgtgaaaaacatgatgaagtcatgtgtggaacagataaacagctcctcgacgaagtcctcctcacgccgcgtcattccgctgacgccgcgaccgcctcgccgctgcgtcctgtatgcgtcgaccggctggcgcttgagatatccaaagtgtgtcagcgtaatcacacagtcctcaaccggaatcaaatcctcgatatcgacctccccgctgacagcgacaatctctgtgcgtcgctcgtctgcgtatttggcgcgcaggactcccaattcctccttgacgatcgacatcacacgcgtatagtcgccgaggattgcctcatattcctttacgcgctccaggatttttgcaagctcctcctcaatcctgatccgttcaagacctgaaagctgtccaagctgcatagccacaattgcggtcgcctgaatatcagtaatgccaaagcgcgcgatcaaattgactttcgaatcgggacgatcctttgaatggcggatgatcgaaatcacttcgtccgtattgtcgcaaacgagcttaagcccctccaggatatgctcacgctctttcgcacggcgcaggtcgtacttggtgcgccgtgtaacaatttcaccctgaaaatcgatgtaatgtgtcagtacatccttcagcggcatcaccttcggcacgccgcccacaagcgcgagcataatgactccaaccgtatcctgaagctggctgtaactgtacagacggttcaacaccacctgcgcatttgcgtcgcgctttaattcgatcacaatgcgcataccgtcacggtcggattcgtcgcgcagatcagaaatctggtcaatgcgtttatccttaaccaggtcggcgatcgattcaatcaaacgcgctttattgaccatatatggaatttcggttacaacaatacgctcccggccgtttgccatctcctcaatttccgtgcgcgcgcgcagcgtcaaccgcgcacgccccgttgcatatgcggcgcgtattcctgcgcgccccatgatcacgccgccggtggggaaatcgggacccttgatatgctgcatgatctcgtcaaggcccgcgtcggggttatcgatgagcagattaaccgcatcgatcacctcgccgagattgtgcggcggtatgtttgtcgccataccgacggcgatacctgtcgatccgttgcacagcaggttagggaaacgcgacggcaaaaccgtcggctcctgaaggcgatcgtcatagtttccggtaaaatcaactgtttccttttcaatatcggtcagcatagaaagcgacattttactcatgcggctttctgtgtatcgataggctgccggcggatctccatcgaccgagccaaagttgccgtgtccatcgaccagcggataccgcatggaaaaatcctgcgccagccgcaccattgcatcgtaaacagacgcgtctccgtgcggatggtaacggccaagcacagatccaacggtatcagcacatttgcggtacggcttgtcaggcgtcaggccgttttcatgcagcgtatacaggatacgccggtgtacaggctttaatccgtcgcgcacatccggcagcgcacggctgacaatcaccgacatcgaataatcgagaaacgaccgtttcatttcatgctcgatatcgacattgtgaatgcgctgttctatcagaacgggatcaaacgcctcgtccttggcgtcgtgttcctgtttcatccgtatcatctcctatcattggggaacttttgccgttcagcgccgtcccatcttagccatcgcgcgccgttcggccgcgctgtaaaccttttcaaaccggtcgccgagcgcctgtcccagcagcgcgcgcagacgatccaacaaatcgtcgtcaagctgatttttcggaatgccaaagacacgccccttatcaaaggcaacggcatagacgccttcataatcatatacgttgacggctcctgaaaaggcgatatagtaatgagcgccgccctccgccacatcgataccgtccgcgtttaccatgagcacatattccggcgacccggcttcgcgcgcggcggcggccttctgattgacatgcttcggataaaacaggatcaacccaagcagtgccagggccgctgcaatcataatccaactgacaatctgtcccgggtcctcgaacgcatagggaacgaacatccacagcacaacaaacacacccaggatctccatattgcggtgcatatctatcttatttttcttatcataaacctccaacgccttgagaacgtcgtcgcggcgtgtttgaaaagtaatgtgcagcgcatcattttcctgcggccgcacgtccgcttggtctgtctggcatcccggcagcccgccggccgcttcttcgctcatacgtcatacctctttttctcaaagtttacacagatatcggcaagcagcgcctccatttcatccctgtgttctccggcctgactttttggaatcaacaggcagcgccgctccgccagcatgatcatataaagtccgtcgcttacgcggatggaatggatcgtgtgccaatatgtctcgacgcgctgttcgttgacatgctcgacacacttattggggtagaaatcaaccaccatctccgcatgcaaataattcagtttgttgtattctttcgttactgcacgtataagcgccttatcataaaacaatttgtaataaaaaaggctgcgaaaaccgagaaaaaagaccatcaaaagtaggatcattgaaaccggcgtcatgggattgatgcccgcaactgtagtcccaagcaaaaaaagtccgatcaccagcacaatcgcgcccatgattgtcatgcgctttttatttttgtcaatgctgtcagccgtcatgacccggtaaaactcgatataatcgtcaagcggcagatgaaatttgagcgtaaacagcttttcatatgtggacgccgtatcgccgtcttccgtttcatccgcctgctttgccaaagcgtccgattccttttctccagccggcatccgcgccgtttcctcccgcatgacttgcgccggttgattctgctcagacggcgcgccgctttgttcctgcacatccccggccggcgcttcgtccggctgctgtctgctgttttcctgttcccgcatgtgtcgtctcctttccagccccggtccaaaagcccgttcgcctccatcaaatatcaaggttctgaacgtatttggcattttgctcgataaagtccttgcgcggcgctaccttgtcgcccatcagcactgtaaagatctcgtcggcacggatcgcatcggccatctccacccgcagcatcgtgcggttgcgcgggtccatggtcgtctcccatagctgttcggggtccatctctccaagacccttataccgctgtacatccgctttcccgcttccatccgggcaaagctcgcggatatactggtcgcgttcctcatcggaaaatgcataccgcacctgcttgccgcggctgaccttgaacagcggaggctgtgcgatacaaacatgaccatgttcgatcaaaggacgcataaaacggaaaaagaaagtgagcagcagtgttcggatatggctgccgtcgacatcggcgtcggccataatgataaccttgccatagcggagcttttcgatgtcgaattcatcgccgataccggtcccaagcgccgtaataacaggcatgagcttgtcgtttccatacaccttgtcgagacgggctttttccacattgagcattttgccccacagcggcaaaatcgcctggaaccgccggtcacgtcccatcttggcggaaccgcccgccgaatcaccctcgacgatatagatttccgttccatcccggccgcgctgcgaacagtcggcgagcttgccgggcagggaagccgtctcaagcgccgatttgcgccgcgcgacatcgcgcgcgcggcgcgccgcctcgcgcgcgcgcgaggcattgatcgacttttcgataatcgccttagcaaccgccgggttttcctcgtaatacgtcgtcagcttttcatagacaagggaactgaccatcgcgcgcatctgcgtgttgcccagcctcgcctttgtctgtccctcgaactgcgcgtctgtcagcttgacggaaacaatcgctgtcagcccttcaagcacatcctcgcccgaaaacttttcatcgtccttaagcagcttatatttatgcgcataatcgttcattgtgcgcgtcaaagccgttttaaagccggattcatgcgtaccgccatccgtcgtgtggatattgttggcaaatgatagaattaaatccgtataactgtcgttatactgcatggcaacctcggctgtattatcgccgtcgcgcgccgccaaataaataatttcgtcatgaatcggctccacaccctttgatttatggatgtgttcaacaaagcttcgaatgcctccctcgtaatggagatgctcctcaaccggctctgtcccacgctgatcgcgcagaacaatataaacgcccgcgtttaagaacgcctgctcgcgcaagcgccgcaaaagcgtatcataatcgtattccgtcgtttcttcaaaaattgccgcgtcagctttaaaggcaacgctggttcccttttcctctgtcggtccggtatttttaagcggttccaccgctactccgcgttcaaacctttgataataccgcgcgctcccgtcgcagacctcgacctcaagccattcagacaacgcatttacaaccgacgcgcccactccgtgcagtccgcccgacaccttgtagccgctgccgccgaatttaccgcctgcgtgcagcaccgtaaagacgaccgtaacagccgggatgccaagttttggctggataccaaccgggattccgcgcccattgtcgcttacctttacgatattcccaggcagcaaatcgacttcaatctttgtacagtgtccagccaatgcttcgtcaatcgagttatcgacgatttcatacaccagatgatgcaggccgcgcggtccggtcgatccaatatacatgccagggcgcttgcgcaccgcctccaggccctccaggacctgtatttgtgaaccgtcgtactcctgctcatccggcacaataccgggattcagctcgttttgatcccccactgtatccactcctttcaggatgctgtttttcatacattggagatgccatctataaacccggcgcgttttttcagcgtcgtagaagaaatctgtgtgatgtagacggttgatttttgtccttcaacacagatcacaaacgattttggcagctcataggacacattgacaacacgtccgccttgttccgattttgcaagaaactcctttgtgattttcgatacggagctgttctccagatcaaaaatcccgacgacatcgccggttcggacaacggtatcctgcccaagatgcaaatacatgctattcctcctgttctttcacgctgtccatcccatggctgctgctggctgcggcgcggccgtcttcgatccgcacagacacgccgcaggacaatcccttgaaatcactgccatcacagcttgtcattataatttgccgtccctgcaaatgattgagcaaataatcgcgccgcgctgcgtcaagctcgctcatcacatcgtcgagcagcacaaccggatattcgccgagcgtttcacggatcaactcgcattcggcgagcttgagcgccaacacacagcttcgctgctgtccctgagaaccaaatgcgcgcgcgctctgcccgtcaagcgtcaaatctatatcgtcgcggtgcggtccggctcctgtcattcgtgtgcggatatcctcaccgcggtgtgcccgcagatcctcaagcgcacgctgttcgatttcgctcatcgacgctcctggatcgacagccagagacggcgcataccgcgctccaaacttctcgcgtccgcctgcaagaccaccgtaaatctcctgtgcgcacggcgcaagccgctccagaaacgtcgcgcgcgtttttattacaactgcgccatatgccgccaggcgcgcatcccatatatcgagcgtatcaaacaagcttgtttcatacataatatccttcagaagccggtttcgctgatcaagcacccttgtgtattgattgagaacatgaatgtatttaggcttgatctgacaaatcgacgtatcaataaaacgccgcttttcctgcggcccgttttttacaagcgtcagatgcgcaggcgaaaaaacaacggcacagaactggcccgccagctctgccgcgcttttcaacgggacctcattgagcgcggcggcgcggcgtttttcaatcgtcaaaagcgccttctgttcgcgtccggccgcataaaaaccagcttcaaccgccgcctgcggcgcgccgaagcgcacaagctgcgcatcctttgcgccgcggaagcttttagctcccgtacacatccacactgcttcaataaagtttgtctttccctgaccattgtcgccatagatcacattggcgccgggacagagcgcaagctccagtgatgcaatgttgcggaaatctgtaatacggattcgatcaattctcacgcgcaaacctcaatttcaagctctccaacgtttacaagatcgcccggcctgatctttttgccgcgcattgcgcatagttctccgtttacccgcaccatgccgcctgttatccattccttcgcctgaccgccagtctgtacggcgcccgcaaatttcaaaagcgcgtccagcttgataaacggcgttgtgattgttacctgcatagggacatcctttcgccgcttattctgatttgaggcgcaccggcagcacgaggaaaacgaacgcatcgccttcgaccggcatcagcttgatgggggagaggggaccgttaatcagcacgcggatttcgtctccttcgctcgctttaagcgcgtcgagcatatatcggctgttaaaaccgatttccacatcgtcgccgctctgttcgcaacgaatttcatcatacgccttaccgatggccgtggaacacgaaattttaatcagtccttcttcaaatttcatgcgcagagggctttttatattatctgagatcagcagcgacgcgcggtcgatcgcgctgatcaaatcgcgcgtgccgatttttactgtcgtcgctccaccctctggaatggcggcgcgataatcgagaaattcgccctcaagcaggcgcgatacaatacggtagctgcctgtacgaaagataatatgacgccgcgctacgccaagttcgacatccccttcctcatcgcgcagcagctttgaaacctcggagagcgatttccccggcacgataaaggaaagagtttcgtcaaacgccaccttttcgcggcgcagcgccagacggtaaccgtcaacagatacaaggcacagctcgccgcccttaatatcaaagagggaaccagtatgaaccggcttgctgtcgctgaccgcaatcgcgaaaagcgtttggctgatcatattttttaaagccgcctgcggaattgaaagctccgtcgtttcagaaacgccaggcagttccggatactccgaagcgggaagcccgagaatggtgtattcggtcatggagccttttacgagcgtcaacatttttgcgtcgcttgagatgctgatttgctcgctgggcatccggcggatcatatcaaggaaaatacgcgcggacaaaacaatttcacctgcttcgcgtacatccgcttcaatctctgttgaaattgccagttcaaggtcgtagccagtaagggaaagcgtattatttttagcgcgaagcaaaacgccttccagcgcagccagcgtatttttggaagaaacagcacgcgaaacgtttgcaaccgcatccactaatagctgcttatcacatattaattgcataaatatctcctttccagcctttttgaaaaaaggcttcggcgaaaaactttaatcggctgtgccgcaaacagtgggtttggcactgcgctgatacaggctgtgccgcgaacagtgggataggcattgagcttatcgggctataccaaaagactgttcctttcgtggttcacatgcagtttatgtttccacactcctattttccgtccttattataagaaagtaagtatataaggatcgtagtagtagtaggggacgttgagatgtataaaagcttgcagagtggcttgcagagccaatttagaagctttttttcattggagagtgtcgttgcagaattgtgaaaatctttaaaaagcgcattgatattaacgatgctgtggaaaactggatgttaaatgagaaaaaatgtggaaaacttcgtggaaaacgtggaagacttttcaggttgttttccacattggggaaaatgtggaaaagtagaatgtgaaaaactagctgtcacggatattttttataatatcctcaatcgtttccttataccgcaaatcgttattcatgtttttttcaacctgctgaattgcataaacaattgtactgtgatcgcggccgccgaattcgtcgccgatggtagacatcgacatttgggtgatttcacggacgatataaatagaaatctgacgggccgctgatatctgcgcgctgcgcttgtttgaacggatgtcctgcggcgagatgccgtatgtgcgtcccacctcggaaatgatgcgctcgacagtgacagggaccggctggttgtcgttgaggatgtcacggatcgcattctgtgcgatcataatagaagggtttgttccctgcagcagcttataggctttcagttttttgacagtcccttcaagctggcggatatttgttttaaggcgattggcaatatattcagcgacatcatccggcatctgaatatcgagaagctgcgctttgcgccggatgattgcaatgcgcgtttcaaaatccgggatctgaatatctgccaaaagaccccattcaaagcgtgtacgcaggcggtcctccaacgttttgatctccttgggcggacggtcggacgcaagtacaatctgcttgtttgattcgtataatgtattaaaggtatggaaaaattcttcctgtgtgctttccttgccgccgatgaattgaatatcgtctacgagcagcacgtcggctttacggtatcgttcgcggaattcagccgtgcgctggtcgcggatggctgtgataatatcattggcaaattcgtcgccctttacatagatgatgttataatttgggcggtttttgcggatttcagcacagatggcgtatagaagatgcgttttgccaagaccggagcctccgtaaataaacagcgggttataggcatttgcggggttggccgcgacagcaagggaggctgcatgtgcaaatttattggaggagccgacgataaacgtatcaaacgtatagtcatattcaccgttgacggccgccgcgtcggaaggcggcggcccggccggtttttcagccggctgcggcgtttcgcaggtaatgatgacatcgaccggaaaacccaacgtcgtttcaaaagccgacttgaggatggaagtatatttttcacggataatgttcattttaaattcggaattaacctgaaggaaagcggccgagccttccaagcgcagaggaatgatatccttgagccacaggttaaaggcgacgtcggagatctgatttttgcagaggtcaaggacaagagcaaataattctgcgaatgaatccataacaggggtactcctcccaataatctgagtggataaccggttgagaacgcagcgggcgtctgtttaaaccggcgctttttacacagtccttcaacggaaccgatatcttttttatcataacacagattcaggattctttcaagtattcaacgggtggctgcatagacattattatatagtatatacttctttcaatgaccgctaggctgcggcgacagccggcaaaaatagccagaggtattgacaaaaacccgtgacatgcggtataatgcttatctgcaaggtaaaaaagaaggaaccgcggggcgccggtgaaaacgcagtgctaaagcggttcttttgcgcatccttgacgaggggaggtttaacgatggtaagaacgtatcagccgaaaaagcttcagagaaaaaaggagcacggtttccgtaaacgtatggcgactcgcaacggacgcaaggttttggcccgcaggcgggcaaagggaagggcgcgcctgacccattaagcgcataaacagacaggcggctgatgaccgacgccgcggatatggccacagcttgcgttgtggcctttatttttatcattgtccgcgccggacggcacgccgcaaggctgcgcgctgttcgctctggaggacagatagcatggcgaaaatccaaacgctgacattgaataaggaatttaaacgggcttattacagaggccgttcctttgctacacctgtgcttgttgtctatgcccttaaaaacaggagcggggaaaaccggctggggctgaccgcaactaaaaaagtgggaaaggctgttaagcgcaaccgagcgcgccgggttatgcgcgaggcgttttatttgattgaacaggagcttgcgcaaggatatgattttgttcttgtcgcgcgcgttaggacagcgttcgtttccatgcagcaggtgcttgaagcgctgcggcgcgcctgtgaaaagctgggattgttgaggtgaaggcgtttctgcttgcggcgatccgtttttacagaagatatctttcaccgcttaagccgcattctacctgccggttttatccaacgtgttctgaatacgcgctgacggcgatttcccgttttggcgcgctgcgcggaggctggcttgcggtcaaacggattttgaaatgtcatccgttccatccgggcgggattgatcatgtgcctgagacgctgccgcggcgaactatcaagaaggagaaataaagcagatgtccttaatttatacgatatttggctatccgctcggatggattatgtgggcgtgtttcaaggtccttccgatttatggcgtcgcgcttgtgctgtttactttgattgtgcgcgtctgcctggtgccgctgtcgattaaacagcaaaaatcgatggtaaaaatgcagattttccggccgcgtatggaggaaatacagaaaaaatacgcgaacaaccgtgaaaaaatgaatgaggaaatgatgaagctctatgaggaggagcattacaatccggcctcgggttgtctgcccatgctcattcagatgcccatcctctttggtctttatgacgtgattcagcgcccgatcacgcatctgctgcgtatcagcggtcctgtgatcgatcaggcgactgagatagcggcgacggtgttgaataatgcgaatttggcaaaggattattcgcgccaaatccgtattattgatgcggtgaatacaaatcctgacgccttttccggacttggcgattttgtatcgaaggtgcagacgctcgatctgtcgatcgggccgatcgatttgacgcagcagccgacgtttgcgctgaatctgttgattctgattccgatcttttcttttttaacgtcgctgctcgtttcgtttgtatcgatgcgtcagacggccgatatgagcggaaacgccgcggccgcggccggcatgtctaaaagtatgatgataatgatgccgttgatgtccgcgtggatttccttcgtggtgccggcgggactcggcgtgtactggattatttctaatatactgatggccgttcaaacgtatctgcttaataaatttatgaatcccaaggagcttgctgaaaaagcgcgcaaggaagcagaggagcgcagggaggctgaacggcaggcgaaaatagaggcgaagaaacgcgcgcgtgaacgcggagaaacggatattgagcaggctctttcccaaaaggaaatcaaccgcctgaagctggctgctgcgcgcaaacgcgacgcggagaaatacggcgagacatatgcagaggtaacggacgacgacctgaaatcataagattacgaaagcggaaaaccgggtgaatcctccaaaacaacgttgcagaaaaaaattctgcagaccgcccggagtatggggcgcaaagagacgatgggtgtacaagcgtcccttaatgggcctgttgacaaagccgccgcagccaaaacagcggcgcttgattccggaatcagttacaaaaaaattgtgaagccccgaagggcatcctgcgttttttgttttatcagccgaaaagtctgctttcattatcggcacggcttggtttgtcaacagcccctatattatcggaggtgtcaaggatgcgtgaggtaataaaagaagcacgcaatgttgaagatgcaatcgaattggcttgtaaagagcttggcgttcagcgtgatgcggtggattttgagattataacattgccgaaacgcggctttctcgggctgcgcaatacgcccgcgcgggtacgtgtttttgtcgaagaaccggagcctgtttcggaaataaagaaggacaggcagccggcgcccaaagaggtgcaggcggcgcccacaaaggaacagagggcggacagagcgccgcaggctgaaaagaagccgcagaaggctatgccgaaacgtgagacgaaacgtgaacagccggcacgcgcacaagttgagactgcgaagaagcaggataaaaatgaacatgttgggatggaaaagcaggaaaaggcggctcaaacaatcacgtttgtcgaagttgagaaggttgaagggaaggcgcgcgttgcggctgaatatgtgcgcggtgttttaaatgcaatggaaattgacgctgaattaagcgttgcgagaacggaaaatggcgtggttatgcgtctgaccggggatggactgggcgtgatcattgggcgccgcggagaaacgcttgacgcgctgcaatatctttccagccttgtagccaaccgggaggaaggagattacatccgtgtaacgatcgattctggaaattatcgtgaaaaacgtgagaggacgcttgagcagctagcgcaaaagcttgccgcaggcgttttgcgctatggccgtccttcaacgcttgagccgatgaatccttatgaacgcaggattatccattcgactgttgcgagaatagagggtgttacctcgtcgtcgacaggagaggaaccgaatcgtcgtgttgtgatatcgccgataaatccgcgtccgctgcagggcggcggaaggggcggccggggaggacgtggacgtgcgggagcaaatcgtacggcgcgtcgtgacgaacgtgtgccgcgcgatggcgaacattcggagcagaggagtgaacgcgcgccgcgcagggaacgcggtcctcgacgcgacgaccgcgcgacgcgtggggagacggttaagccgacatcgacagaggtagaccgcgcttatgctgccgaattggagcgcgaaggcgcattggaacgccctgcacaggcaataccaaggacgcagcagaagcctgtccgccagcaggcgcgccatgagggtgatgatctgccgttgtatggaaagattgatctttaagtgtttgatgatcgtgggggaggatgtttcacgtgaaacatcctcccttttgtcaataaacgtaaaacagggaatgcagctttatgatgtttttgttgactgcctttatcggtgtagtggaggattgttatgggtgaaatcgatacgattgcggcgattgcaacgccgcttggaacaggtggaattggaatcgttagaatttcgggaccggatgcttttggtacggctgaaagaatcgtgcgcttagcgaaaggcgggagggtttcctcactcgcgggctatacctgcgcctatggtctggccgctgatcaggagggaccgattgacgaagtgatcgtcactgcttttcgtgggccgcacagctatacaggcgaggatatcgtcgagatatccgcacatggcggcgtttatttaatggaccgtcttttgaatgcctgttgtaagaatggcgcccgtcctgcactggcaggagaatttacgaaacgggcgttcctaaacggaaaacttgatctgacgcaggctgaggcggtgatcgatctaatctctgcgcacggcggacaggcggctcgcgcggctttatcggcgcgcggcggcgcgctgtatcgatgtgtaggggagattacggacagactgacctattttgcggcgcatctgtctgcttggattgattatccagaggaagaaatagaagcggtcgatccgaacgctttgcagagtgatttggcagagtgccttcaatcgctcgacagtctggctggatcgtatgaaacgggacggcttgtgcgcgagggtatcgaaactgtgattgtgggtcggccaaatgtgggaaaatcatcgttgatgaatttgatgacaggcgtgaagcggagtattgtctcggatattcctgggacaacgcgcgatcttgtcagcgatacggttttatgcggcggttttgtttttcatctcacagatacggctggaattcgaaagccggatgatccaatcgagcaggagggcgtcggcttggcgcttgaacagatagagagggcgcagcttgtattggctgtgtttgacggatcggagccgttgacaggggatgaccggcgcgttatggaagcttgtcgtggattgaacgcgcttgccttggtcaataaggccgatttgatgcaggtgctcgatgcacaagcctttgcatcggattttaagcgcgtactttcgatttcagcgcatgacaccaatatcatgaagcctttgacggaggtattgactgaaatggtgggattgggcgcctttgacagttccgctgcgatagtagcaaatacgcgtcagcgagcggcggtgatggctgccgccggggagctgcgggaggcggtagaggctttggaaaacggtgtttcctacgatgcggttgctgtttgtatcgagcgcgcgctcgatgcgctgttggaattgacaggaaagcgtgcgtcacaggcggttgttgattctgtgttttcacggttttgtgtaggaaagtgacatgcagaagggggaatcatggatggattatgaagcgggaacgtatgaaattgcggttattggaggtggacatgcaggtatagaggccgccttagctgctgcgcggcttggcgcgcaaacggtgctgtttaccatgtcgcttgatgcaatcggaaatatgccctgtaatccatcgatcggtggaacggcgaaagggcatcttgtgcgtgagattgacgcgctcggcggtgagatgggacgtgctgctgatgcgacaatgcttcaaagccgcatgcttaacagggggaagggtccggcggtccattcactgcgcgcacagacggaccgaaaggattatcaccggtatatgaagcatgcggtggagaatcaagatcgactcgatgtaatacaggcggaaatagtggatatcagggcatccgacggtgcggttgagtctgttgtgacagcgttgggtgcgctttatcatgcgcgtgcggttattctctgtacaggtacttatttacgtgggcgtatttttgttggagagtatacagcgcaaagcgggcctgacggtttgcatgcagcggatcaactgaccgcggcgcttgagcgtcttggtttgccgctgcgccgttttaaaacaggaacacccgcgcgcgccgaccgccggtcgattgattttcaatcgctggaggtacaggagggtgacgatccgattacccccttttccttcgaaacggacgggggaatgctgaaaaacagagcagtttgtcatatcgcatatacaaatgaacagacgcatcgcgttatattggaaaatctgcaccggtcgccgctttacagcggacagattgaagggattgggccgcgctattgtccaagtattgaggataaggttgtgcgtttttctgataagccgcgtcatcagattttcattgaaccgatggggcttgatacgaatgaggtttatttgcagggtatgtcttcgtccttgccggaggaagtacaggtaaagctgtacaggacagtgaagggctttgaacagatacgcattatgcgcaacgcctatgcaatcgaatatgattgccttgatccaacctgtttgcaggcgacgctggaatgcaaggcagtgcgcgggctttatggtgcgggccagttcaacggcacctccggctatgaggaagcggccgcgcaaggtttgatcgctggtatcaacgctgcgcgtgccgtacagggaaaaacgccgcttgtgcttgaccgtgcgagcagttatattgggaccttgattgatgatcttgttgtgaaaggctgcaacgatccatacagaatgatgacatcacgatcggaataccgtttgattttaagacaggacaacgcggacatgcgtttgacgccggttggatatgaaatcggtttgatcggagcggagcgctgggcagcgttcctgaaaaagcgagaactggtggaaggggagataaggcgcctgcgtgcggtgcatacagcgccaaatgaaaaattaaatgcgttgcttgtttcacgtgaaacatcgcctattgcaacggggatgcgtctttgtgagctgctcaaacggcctcagctttcctatgcatcgcttgcacccttcgatccagagcgccctgacttgcccgcacaggtctgcgaacaggtggaaataacaattaaatatgaaggatatatcaaaaagcagcttgagcaggtggagcagatgcggcgtttggagggaaagcagcttccaggcgatctggattatcaatcgatcggcgggctgcggctggaagccgtcgagaaattgatgcgcctgcggccattgaacatcgggcaggcatcgcgtatcagcggcgtcagtccggcggatgtgtctgtgctgttgatttggctcagtcagcaccatgcatccacacagaaggcaggggaggaaacaaatgattgaacgggacatgttaaaagaatatgcggccggtttcggcgtaacgcttgacactgcgcagttggatgcttttgaccgttatgcggcgctgttggttgaatggaatgcaaaaatgaatctgacagcaatcactgaaccacaggaaattgtgatcaagcattttgtcgacagtctgtcgttgctgtcgctttgccccatcccgcagggggcgcggcttgtcgatgtcggaacaggggcgggctttccgtccgttccgctgaaaattgcacgaccggacctgcatttgacgctgctggacagtctgaataaacggattacattcctgcaagaactgtcacagtccctgggacaggacaatgaatgtattcatgcacgtgcggaggaggtgggacgaagcccggtctatcgcgaaaaatatgatatggctgtttcgcgcgctgtcgcacggctgtatgaattgagtgaatattgcctgccatttgtcagggccgggggaatatttgctgcatataaggggaatgattgtgacaaggaatgtgccgaagctgggcgcgctgttcatctgctgggtggggagctgaaagcggtcaagcgccttgggctgcctgatggaagcggccgggcgattgtgctgataaaaaaaagatcgcagacatcgacaaaatatccaagaccacatgctaaaatagcaaaaaatccgctggtgtaatgaaaacaccggcggattttgctattttctgcgatgaaaagtgctggaaatttggaatatttcatggtatgatgcaggcatggacaagataaagaaaggatgcggggagcatgaagttttcaaagcaacggaccgtcaaccgtgttgttctgatcgatgttgaccgcatcgtgcgcagcccctatcaaccgcggcgtcaatttgaaccgcgcgccatgcaggaactggcagacagcattgcacagagcggcctgctccagcctgtgacagtgcgcgctgttggaagcggctatgaactgatcgcaggcgaacggcgcttgatggcgtgccgcatgaatgggattgataaaatccccgcgattgtggaacagtttgataatgaaaaatcggccgtttttgcgctgattgagaatttacagcgcaaagacctcaactattttgaggaagcgcagggaatccgcaggctgatggagctgtgcgatatgacgcagcaacaggtggcaaaacggttgggaaaagcgcagtctacgattgctaacaagctgcggctgctcaatttcagcgaagaactgcgcaggcggatgcttgatgcaggattgacagagcgccatgcaagggcgctgctgaagctggaaagcgatcaacagatcgaagccgcgttggaaacgattacgcatgaacgcctgaatgtgggtgaaacggaacggttgattgagacaatgctgactgcggtgccggaacctgcgcctgtaaagccggagcagaaagcgaccaagctgtttgtactgaaggactttcgtatcttcatgaatacgatcacaaaagcggtttcgacgatgaagctggctgggatcgatattgatacagaaaaatttgaggacgaggaatttatcaattatacgatgcgcatcccgaaaaaaagcgcataccgtccacacagcgcataatagaacaacaaagaaggccatccgccacaggccgcccgcagggaggacagcgcccgaaaaagcggctgtggtttggtaaaataaatacacgtttccctgcaacacaagccgcccaaacgggcggctttgttgcgtcttaaaagcagattgaagaaatgaaaacaaagctgcgatgtttcacgtgaaacataaaagggtataaaggtccggttcagtgatgggatctgtaaatggcgccgcggccgaatgagcaggacaaaaggcttttctttgagaaatgaatgtggtataataaccgcagagcggttattataccgggttatgcccagcggctcgccgcttgcgcggcaaccgccttttgatgggcaattataccatgccgcttcgcggacatggtataatatgcgcagtgcaaacgacaaagccgtttgcagccgccatatggcggcaaacgctgcaaagcagcggattgcgcatgttacaccacagtcaaaaccggctttgccggtttccctgccgctttgcggcaggtaagcccgaatgggcttgttgctgtggtataatcataaggcaatccatgttgatggaaagatattcgcttttagggtaccggagggaaaaaatgggcaagataatcgcggtggcaaaccagaaaggcggggtcggcaagacgacaaccgccgtcaatttgactgcggcgctcggcgcgcgcggataccgcacgctattggttgatgtggacccgcagggaaattccacatcagggcttggtatcaataaacgcagcttggcgtgctcgacatatgagctgcttgtctccacggctggggctgaacaggcgctccagcatacgccgtttcaaaacgtggacgtgcttccctccaatatttcactggcaggcgcggaaattgaactggttgagctcgataaccgtgcgatgcggctgaaaacggcgcttctgaggattcgggatcaatatgattttatcttgattgattgcccgccgtcgcttggaatcatcactttaaacgccttcgcggcggcaaattctctgttgattccaattcaatgtgaatattacgccctagaaggactttcgcaactcattgcaacgttgcggcaggtaaagcggctttataatcccgatatagatatcgagggcgtactgctcacaatgtatgacagccggcttaatttgacggtacaggttgtagcggagctgaaaaaatactttccacagaagatttaccatacagtcataccgcggaatgtgcgcttgtccgaagcgcccagttttggacagccggttttgtattatgaccgttcgtcaaagggcagcgccgcctatgaggagctggccgaagaattcttgaaaaagaacaggaaaaaaagggggaactgatttggcaaaagcgaaaggcggactgggtaagggtctggaggcgctgtttgccgacaacagcacggacagtggagctgtttcatcgctggctgtcagcgaaattgaaccaaaccgcggccagccgcgccgccattttgacgaggcggcgcttgcagagctggccgattctatccggcagtatggcgttttacagccgcttgtcgtccgtccgatggaatcgggaggctatcagcttgtcgcgggtgagcggcggtggcgtgctgcacgtatggcgggactgtcacaggtgccggtggtgatccgggaattgagcgacagtgaaacaatggagcttgcgcttattgaaaatctgcagcgcgaggatctcaatccaattgaagaagcagccggataccgggagctgatggaaacgtttggattgacccaggaacaggtgtccgagcgcgtgggtaaatcgaggccggtgattacgaatgcgatgcgtctgcttggtctgccggacgccgtgcgggcgctcgtaagccagggggagctgtcggcaggacacgcgcgcgcgctgctcggtcttgaaaatgaggctgtaatctgtgcgctggcggaggaaatcattaaaaagggttggtctgtcaggcaaacggaagcctttgtcaagcgtcagaaacaggcggaaaaggcggaggaggaagcgccgcgcaccgcatgggacaacagtacgttcgcggaggtgcagcttgccttgatgcagagcctttcacgcaaggtgcgtgtagaatgcaaaaagggtgaaaaaaagggaaggctagtgatcgagttttatgacgagcaggacctgaaaggcctggcggcgttgttcgacagggggcaggggtaagcaagagacgataaattgacggcggctgccccactgttcgcggcgcagccggctaaagttttttggcataccttttttcaaaaaaggtatgaagttttttgccgggcttttttcaaaaaagcgggaaaggggtagaaagatgctcgatattaaatttgtccgggctaatccggatgcagtcagggaaaatatcagaaaaaaatttcaggaggaaaaactgccgctggtcgacgaagtacttgaacgcgaccagaagttccgggagacaaagacgcgctgcgataatctgcgcgcacagcgcaataccatcagcaaacaaatcggcggattgatgggcaagggtctgcgcgaggaggccgaacaggccaaaacgcaggtaactgcgatggcaaaagagcttgaggagcttgaggagcttgaaacgaagcttgaagcagagatccgcgagcggatgatggtgatcccgaatattatcgatccatctgtgccgatcggccgggacgacagcgagaatgttgaggttgaacgctttggagaaccgacagttccaccttttgaggtgccctatcatgtggagatcatggagcggctcaacgggatcgatcttgacagtgcgcgtaaaacaagcggcaatggcttttattatttgtgtggagatattgcgcgtctgcattcagcgattctgtcctatgcgcgcgactttatgattgaccgcggattcacttattatataccgccgtttatgatccgcagcaatgttgtcaacggtgtgatgagctttgccgagatggaaaacatgatgtacaagattgaaggggaggacctctatctgatcggcacaagcgagcattcaatgatcggcaaatttatcgatactatgcttgatgaggacaagctcccgcagacacttacaagctattcgccgtgtttccgcaaggaggtcggcgcgcatggtatcgaagaacgcggcgtctaccgcatccaccagtttgaaaagcaggagatgattgtcgtctgcaagcccgaggacagcgccgcttggtacgacaagctttggaaaaatacggttgacttcttccgctcgcttgatatcccggtgcgcacgcttgaatgctgttccggtgatttggctgatttgaaagtcaaaagcgtcgatgtagaggcttggtcgccgcgtcagaaaaagtattttgaggttggaagctgttcaaatcttggcgacgcccaggcgcggcgcctgggtatccgcgtcaggaataaagaaagaggcaactactttgcgcatacgctaaacaacacggttgttgcgccgccgcgtatgttgatcgcgtttttggagaacaacctgaacgacgatggatctgtacgcattccgcaaccgctgcgcatgtatatgggcggtaaggacgcgatccggccgtaaaaggatgccatgtgtcagtgcggaaaaataaagcaagccatatgtgaaataaaagccgggtctgcctgaaaaggcggacctggcctccaggaatgatgagaggcggcgtatcgcttgatccgtgagtttgaaaaatggatagaagtaaccgagcctgaatgcgatctaacgcatcgtatgagcttatcgaatattatgcgccatacgcagcagatgggaagcgatcatatcgcgcgggaagggattacctatgaacggatgcagcaggacggcatggtgtttcttgtcaataagatgctgattacaatcaagcggcggccggtttatgctgaacgcctgcgcctggtcactgtcccgcgcgtgcctaagggcgcgcagtttatccgggacacctactttgataccgaacaaggggaacggcttgtcgagacaagcatttcctggattctggccgatccgcgcacacaccgcatcctgcggcctgcggcgtttgatatctatggacttgagatgtttccaaacgacggggagtatatcaccgcgtaccggatcaaaaaaccaaatgcagcgggcgtgcgccatatgcgccaggtaaagtacagcgatcttgattcgaacagtcatgtcaacaatgcggtttatgcggatattgtctgcgatacgctgccgttggattggcttgttgaacgtgaaattaaaaagttcggtattatgtatcaaaaagaggcgctcgcgggacaggtgatcgagcttgataccgcacagatttcgcaaagtgcatattatgtgggcggtatggctggcggcggacgctgttttgaagcggaaataaattttacagaaaagctgcaaagctattgacaaaataaagattctacggtataatttagtacgctcgctcatataataagggagcagaaaatggcggtatagctcagttggctagagcattcggttcatacccgaagtgtcaccggttcgaatccagttaccgctaccagtcgggcctcactgctgcgtgaggcccaatgtttccggcctgttcgtcaagtggttaagacaccgccctttcacggcgggttcacgggttcgaatcccgtacaggtcaccatcaggcaaaagcttggagcgccatctggctccaggctttttcttttccaaaagttaccgcccacgcccagcctacagtaattttgggcaattgccgcaaaagcctccggttcaatagaagcggaggcttttttgtgttttaagagaaatgtaaaatggagcaatttgccccttcttgactttaagaatcggatcaattataatctaaacaatagactgtataagtgtgcaatgatgtagaaaaacaagcgatcaaatatggaggaagcacggattgaaaaaagtaaatatgatcaagcgtcctaataaacgtttggtgctgtttttaacatctttatccggaatggtttttttaacggcaacatttggaattatatggtatacatgttatgcgcaggaaattgtacagcctttttttagaaaaggaaattggctggtaattgctgtttatgccttaacactttatatatttatgcgtatttatggtggatttcgcattggttatcttaaaaggagcgacgttatttattctgcgatcctttccatgttgattacaaatgttttgaattatttgcaaattggattaattggacgcagatttatgaattttgcgccaatgttaattttgacaataacagatatatttgtcctgataatatgggcttgtttttcagaaaaattatattatcatctttatccgccgcgccggatacttttaatatatgaaggaaatcagccgaaaggtttgctgtcaaaaataaacagccgttcggagaaatataatatttgcggagcggttactgttgctgaggactgggaaactatttgtcaggcgattgggcagtatgaagcggtgctgatttgtgatgttaaatcggatatacgcaacgagcttctgaagtactgtttccggcaatcggtacgtgtctatctgacgcccaagctttccgacaccattattcgcggtgcagaggcgattcatttgtttgattctccattgttgctttgccgcaacaggggacttgatttcgggcagcagacagctaaaagaattttggatttggcaatatctttgaccgcgcttgttttaacttctccaattatggcaattatagctgtaacgatcaaatgttatgaccgcggtccggtattataccggcaggaacgtttgacagagggagggcgcattttcatactgtataaatttcgcagcatggaggtcgatgcggaacggtacgacgggccgcgccttgcaagtgagaatgatacaagaataacatctgtcggcaaatttttgcggaggttaagattagatgagttaccacaattaataaacatcataaaaggtgaaatgagtattgtgggtccgcggcctgaaaggaaagaaatcgcgcaacagtatgcacttgatatgccggaatttgatttccggctcaaggtaaaggctggattaaccggctatgcccaggtatatggaaaatataacacatcaccgtatgataagctgaaaatggatcttgcctatattgaaggatattcgctttggcttgatattaaaatcatcctaatgacaatcaaagtgctttttacgcgtgaaagctcacaggggctttcagatgatgcggccgatcaattattgcgcagaggagagaagcagcaggtacgcgcgaaacaatgacagttcaaaaagccatattaatttccagctttgttccttccaataatgcatcgccggttgcggtgaattacaaaatgatgcggctgtgctgcgatgtctttgaacaaacagaatttctaacggcaaattttccggcgcaggctcttgcagatttgccgtcacatcgctttcgattgacaaatcttgtgccggagtttacgacggaccattctttacgcgccgtatggggctatttacgtatgcaagccgctgcaatccgccgcatacacgctttgcggaatcatgcgccggtagtcctgttctggctttccggaccaatgatccttccgtttctttactgccgtttggccgggctttatacagttggattcctttatggaaacagccgccgcaaggcggaacatataacgctagtaaacttcctaaaagcggtgctgatggaatatatggcacggcatgccgatgcggcctgtgtggagtcgccgtctgtagcacatcattggaaaattgattatgagcgcgaggggctgcatacggtgcatctttatgtggaggatgcctttttcaacgcgggtctttcatatactgaacgcccgccggtaattgggatctgtgggcgcttggcggcaagtaagcgtattttggaggctgtgcaggcttttcatcagtttcgccgcagctttccggaatactccttggaaattgtcggagacggcccgctgcggaaggagtgcgcgcagctgatcagccttttgggagagcaggcacatatcaaaatgcttggctggatcgaccacaaatccctgcctgattattatggacgctggcggttgtttctcagtcccaccaattatgagggccttcccaacgcgcttctggaagcaatggcggccggcgtaccgcctctggtcagcccggtgggcggcgtgcccgacgtcgtccgggaaggcgaaacaggttggcttttatcagagaatagcagcgccgttattggcaagcggcttacagcgctcttttcagatataagcgcaatggagagcatctccaaagcctgccgttttgaaatggttcagtatcaatatgcacggacgcgggacgcgttccggtatttcatacgaacgctggataataaaggggaacgtgcacgcttataagaataaaggattcaggtgttataaagcattgatttttctgataggatgttaataacctggatataggaacctgtcaatgatttaagtttcagatgcaaaaagaaagggagacatgagatgaaaggaattatattggccggtggagctggtacacggctatatccactgacaaaagtgactagtaaacaactattgcctatttatgataagcccatgatttactatccgctgtcaactctcatgttatccggaattcgggatatcctaattatttcaacaccgactgacctgccgaattttcagcggcttttaggcggtggagagcagtttggaatccggttgtcttatcaggttcaaccctcgcctgatggtctggcccaagcgtttattctgggtgaagaatttataggcggcgatcgctgcgctatgattctgggcgataatattttttatggagctggattgactgcccatcttagacatgcagtggaacaggagacgggcgctactgtatttggatattatgtggaggatccagagcgttttggcgtagtggagtttgacacagaagggcgagcggtatccattgaagaaaaacctgtcaggccgcggagcaattatgcggtgaccggcctgtatttttatgacaaaaatgtatgccggcgcgccaaaaacctgaagccttccgcgcggggagagttggagataacagatttaaaccgcctctatctggaagaaggaacgctcaatgtgattaccttgggacgaggttatgcttggctggatactggcacggtggaatctctatcagaggctgcggaatttgtccgggtgatcgagtcccgggaagggatccagattgcggctttggaggaaattgcatttcgcaacggttggattacaacggaacaacttcaagacgcagcgaatgcttatggaaagtctccatatgggttccacctatgcaatgtggcggctggaaaatatatttattgagctttgagaggtgtgggcaatgaaatttacaaagacggagctggatggcgtgtatctggcagagccggaagtctttggagatcaccggggcttttttatggagagctggtctaagcgtgtgtttgaggatgccgggctgttttatgattttgtccaggataaccactcctgttccacagtcaaggggacgctgcgcggtatccattttcagcggggagacaaggctcaggcaaaattggtacggtgcgttaaggggaaagttttggatgtagctgtagatttacggcccaacagccctgcctataaaaggtgggtggcagtggaattgtcagctgaaaataagaagcagcttttgattccacggggatttggacatggctttttaacgcttacggatgaggtggagttcctctataaggcggacaattattacgcgccagaggccgacggcgggattcgctggaacgatccggagttggcgatcgactggggtatttccgagccggtcctgagcggcaaggatcagaacgcgccttggctgaaggatgctgcaacgggctttgaaatgtattaaggagcagatgaacaatgaagctattggttactggcggcgccggatttatcggaagcaatttcattttttatatgcaaaaaaagcatcctgactacaatttgctctgtgtggacaagttgacctacgccgggaatttagccacgttggcgcctgttatggaagaccccaaatttaaatttatccgggccgatatcgccggccgggaggctatctatggtatttttgaagcagagcggcctgatatcgttgtgaattttgcggcggagagccatgtggaccgctccattgaagacccggcgatttttttaaaaaccaatgtgatgggaacgcaagtgctgctggatgcctgtcggaaatatggaatcagccgctatcaccaggtatctaccgacgaggtatatggggatctgccgctggaccgccccgatttgttttttaccgaacagacccctctccatacatccagcccctattcagcatccaaggcggcggccgatctgctgtgcaatgcctaccaccggacatatgggctgcctatcacgatcagccgctgctccaataattatgggccctaccagttccctgaaaaactgatccccctgatgattgccaacgccttggcgaacaaaccgcttccggtatacggccaggggctgaatgtacgtgactggctatatgttgaggatcactgtgttgccattgaccggattttggaacgagggcaggcgggacaaacctacaacatcggcggtcacaacgagatgcgtaatatcgacattgtgaagttgatttgccgagttttgggcaagccggaaagtctgatcacttatgtgacggatcgtaagggtcatgatatgcgctatgctatcgacccgactttcatacacgagcaattgggttggctgcctgccactaaattttcagacggtatccaacggacaattgagtggtatctgaataatcgttcctggtgggaggaaatcgtgaacggagattatcagaattattatgaacggatgtatgccgggcgctgagaccccgaaaattgcgattttgatggctgtctatgagccccggctggattggctgcgggagcagctgctatcgctggatggccagacctatcccaatataaaactctatattcgggacgattgctcaccgaccgtaccaattgaagcgatccaagcctgtgtcagcgagagtatccgctctttttcctgggaactttggcgcaacgaaaaaaaccttggctccaccggcacctttgaacggttgaccgcggaggctgagggggcatacttcgcttactgtgatcaggacgatatctggctgccggagaagctgagtctgctgcaaaaagagatagagcgcgagcgggcgcagttggtctgttcggacatgtatgtgattgacaggcagggcaggcggaccgcagacagcattacccaagtatataaacactttcgattttacagcggtgagggcttggcggaaaaactgttgatccgcaattttgtcgccggatgcaccatgcttatccgggcagatactgcacgggccgccgtccctttctgtccctatatggtacatgaccattatttggcgttgaaggttgcaatgtgcgggaagatagcgtcactgccgcgccctaccatttcttaccggatccatggggaaaatcagactggttccatgcaggggataactgataaacgcagttattatgataaacagattttgcagcatgtgaagcggttgatatggctccaggaaaatatagacggcgctttgaattttgcagctgtaatagatcaagcagtcatatggacaagggccaggtcagattatttttcaggtaagtggaagtcctggtgggaaatttggaaataccggcattttagtgtggttacatctctattcgagttggtattcgcacggatgccggaatttatcttcatgtttttgatcaggcttagacagaagcgtattttataaagaggtaagtatgagagtatttgtcactggagccagcggacaattgggttatgacgtatgtaaggaattgacgcggagagggatcgaaaattggggtgtttccgttgaagatctggatattaccgacagaaaggcggtggaagccgctcttgggaatgaccgtccggatgctgtgattcactgcgcggcttacaccgcagtggataaggcagaggatgaagcggaacagtgttgggcggctaatgtagacgggacccgaaatctggcagtttcctgtaaggccattggcgcaaagatgctgtatgtttccaccgattatgtgtttccgggactgggggaacagttttacgaggtcacagatgcggtgaatccaaccaatgtgtacggagcaagcaagctggccggcgagttggttgttcagagtctgttgacagactattttatcgttcgcatctcatgggtatttggtgcgaacggaaataattttatcaaaactatgctccggctgtccaaatcgaacacggaattaaatgtagtctgcgaccagatcggcagccctacctataccgccgacttggccccgctgctgtgcgatatgatacggacggaccaattcgggctataccatgccaccaatgagggagtctgttcctgggccgagtttgcagaggagattttccgttgtgccggaaaagaggtaaaggtgaaccacattctgacgaaggagtatcctacccgcgccaaacggccgctgaattccagattgagcaaacggatgttgtccgcgcaaggcttccggcccttgccggaatggaccaacgcgctgcgacgttaccttatagaaattggagaatcgacttgaacatgaagcgttttcagaagggctgcatgattgtgctggcctgttatatcgtgttggcagtcgggttctattggattgccggcgatcagctcagatatcaaagcctgtctacagacgctgttcatgcagctgagccagtgggtgagctggtgcagggcatgaatgtgcggcagccgtttatagcgcaagccgacgaattgtctgctgtgtctatgctcttatcgacctatgcaagggaaaatacgtctcatcttgaggtcagcatcgaggacgtccagggagagatcttggcagaggcggtggttcctgcggcggatatcgaagacaacatcgtgcggactatttcttttgttgagccggcactgctacggaaaggagcggaatatgcgctcgtgctcacttcgcctgatggtcagccggggaatgcaatcaccccctggatgggcagcaccatgatggcgggcaggggggaggtggcgttggaactgccgcgggacaagcagcttgaggtcaacgggacggtcactgggaagattttgcatttccagctccagatgaaaaacgatttctgggtgggccaatattactggtacctagcggccggcggcggtctgctgcttgggctttaccttctgcggcttgtccagtcggtcaaaaaacagaagaatattttgggcctgcgtctatattggatgtttcagcgctacggtttcttggtgaagcagcttgtagcgcgtgattttaagacccgttataagcgttccatccttggggtgtgctggagttttttgaatccgctcctgacgatgaccgttcagtatgtggtgttttctactctgttccggtcggatgtaccaaactatgcactatatctgttgtcaggcattgtatgttacaattttttcagcgagtcgaccggtttggctttgacatctataacgggaaacgctgcgctgatcacgaaagtctacgtccccaagtatatctatcctgtttccagagtgttgtcctcgacggttaatctgctgctgtctttgattcctctgttgtttgtcatgattattagcggcgttaaaccccgtccggccatccttctgctgccttttggactgagctgcctgctagtattctgcatcggtatgggatttttgctgtccacgctgatggtgtttttcagggatacacagttcctctggtccgttatttccatgctgtggatgtatatgacgccgatcttttatccggagagcattatcccacagcagtatatgacgctctataaatgcaatccgctataccacattatccgatttgtccgctgcattttgatcgatggcgtatcccctgctccaagggcctacctttactgtctggttgtttcctttgtaccgcttgtggtcggagcgatcatttttaaaacaaaacaggataagtttattttgaatctgtgaggcaagcttatgatcaaggcggaaaatatctccatgcggtatttgatgaatacagaccggattcaaagcatgaaggagtatgtggtcaaatttttgaagcgggagatcaaatataaggaattctgggccttgaaggatgtcagtttcgacgtccgaaaaggcgaggttttgggaattatcggtcacaatggggccggcaaatcgacgctgctgaaggtgatctccggaatattgaaacccacggaagggacgctgcaagtcaacgggaccattgttcccatgttggagctggggagcggatttgactttgaactgtcgggccgggagaacatctttttaaacggcgcgatcctgggctattcggaaaaattccttcaggacaaatatgatgagatcgttgctttttctgagttgggggaatttattgaggctcccttgcgcagctactcctccggtatggtgatgcggctggccttttccatcgcaacggtagtgaatccggatattttgatcgtggacgaaatattggcggtgggcgacgccgcttttcaggaaaagagcaaaaaaaggatgctggagttgatgggcggcggcacgactgtgttgtttgtatcccatagcctggagcagatccgggagatgtgtgaccgggtcctgtggctggaccacggacggatgaggttgtgcggagatgcgcaaagtgtgtgtgatgcatatcagggaggatagggaggatttacacagatgagcgagatatataatcaagaatactaccataccgattgcgggcctatcccatatgaggaaccggaacaatgggaaatattttttggcgcgattgcagatcgcatcgttcaggacttgaggccgagaaccgttttggatgccggatgtgcgatgggatatttggtggcggccctgcgggaaagaggcgtcgaagcatatggtattgatatttccgattatgcgatctgttgtgtaagggaagatatccgcccgtattgcgccgtaggttctttattggaccctttgcctgagggattgccggaacagtatgatgtggtggttacaatcgaagttttggagcatctatatgcagatgctggaaaaaaggcgatccaaaacttgtgcagcttggcgaatacggttattttttcttcctctcccgatgattttacggaaaaaacgcatctgaatgtccagcagcgggagtattgggcccggttgtttgcagaaaatggtttttatgatgacctgaactatcggccaacctacattacctatcatgctgcctgctatcggaagaaaagtgatgtgctgcggcagattgaggattatgaacgtaatatccgcctaatggatggggttcaccgggatatgctggaacaggcggcaaaaagaccgttccaggctaatctttactgggcgggaaatgaagaaggattcagcgaagctcagacgcttcactatataggtgatgaacgcgatggtcaagtacggatggaagtgcgtcttccaaaggtatcggccttgcgttttgatcccgcagaaaaaccttgcatcgtagaagatttgcatgtgtactccgatatagggacgctgcgggcagttccggaaaatggaatagagtggtcaggatatacagtttttttggagcaggatccaaagtttcgaattgaattggaaggtaaagcgatttcgtctcttataatacgcgcccatgtgatccccctgcaatatccggaaaataccgggatactggcgcagttgtttgccgattgggaggacgctaagcgggagcagaaccgtctgaatgaagaactgtcccgcagagaaggagcgtaccgctctgccgctgccagacaggaagctgtacagcaggcgcagttgaagcagcaggaggagcagtatcagacacagctgaagcagcaggaggagcaacatcagacgcagctggagacatcccgccgacagattgtgcaattggaaaaagataagcgggcaatgcaggaggaacttgcccattacaaaacgcattaccatgccgcgattgttcagcgggaagaattgaaacgaaagctgtccgatagcgagcgagcttacagtgaaatatctaatgcttttttctggaagataacatggatattccgcgttattgttgacatggtgaaacgtccctttatcaagacccgttatgggcgcttatttggtaagggaatgcgaagcttgaaaaaaaatgggttgaggaatacatggagaaaggtccaggactggcgcaagcaccggcaaaattttgtggggctggcgaaaaaaccattgttcacaaaggaagaactggaggcccaacggcacgttcagtttgccagagacgtcaaattcagcattgtggtgcctctttacaacacaccggcgcggtttctgcatgagatgatccggtccgtattggatcagacctatggaaactgggaactgtgcatggcggatggaagcgacgctcaacatgaaaatgtcggacagatctgcaagcagtacgtccgaaaagacagccgtatccattatgtgaagctggaaaaaaatttagggatatcgggaaacacaaacgcctgtctggagatgtcgacgggtgattacattggcctgtttgaccatgacgatctgcttcatccagcggcgctgtttgaggtcatgcgggcgatctgtgaacaggatgcggattttatctatacggatgaaaatacgtttcatgacaaaccggaagatgcgttttgtccgcatttcaaacctgattttgctccggatacgttgagagcgaataactatatctgccatttcactgtatttaaaagacaattaatggatcaggctggcaggtttaactccaaatatgatggcagccaggattttgatatggtcctgagattgacagaaaaagcggaaaagatttttcatatcccagaaatactttatttttggcgcgcacataaagactctgttgctcaagggatcgaagcaaagccatatgtgatagaagctgcaaaaggggcaatcactgagcatctttccagagtcggcttggaaggttttgttgaagatactgtagttccatccatgtatcgcatcaaatacacgattaaagcgatacctaaaatttctattatcattgcaaattgtgaccatgcagatgatctcagaaaatgcataacatcaatacagaaattaacaacatataagaattgggaaattattattgtagaaaataacagtattgaaattgcaacccgagattactatcaagaattacaacagttggagaatattaaaattgttacatgggaagcaaaaaatggagagtttaattactcggcaatcaataactatggtgcaaaatttgcaaccggagaatatattctgctgcttaacaatgatacagaagttatcagcgcagattggattcaagaaatgctgatgtttgcccagcgcacggatgtgggggcggtaggagcaaaattgtattattttgatgatacaattcaacatgcaggtataggtatcggcatactgacgttggctggccattatcataggggcttcgaccgctgcgattttggatatatgggtcggctgatctacgctcacaatgtgtccgctgttacagctgcctgcatgatgattcggcgtaatgtatggaaagaagtaggaggtctggatgagacattccaggttgcatttaatgatgtcgatttgtgcatgcgaatccgtcaggcgggctatttgattgtatggacgccatatgcggagttgtatcattatgaatccaaaagccggggatatgatgatacaccggaaaaacaaaaacgctttgaaggagaagtacgccgttttcagacccgatgggcaaaagaattggccgctggagacccttattataatccgaatcttacattagacagagaggatttttcactaagatgaaaaaacaaaatggcattgccaagcgattaatcatttgctttatagtagcaatcttaatcgagctcgcaatagtttcatctcagccaaatcagtacaaatattcgttcaaggatggcacttctgcgctatctggagattataaaattgaagtaagcggatacgagtataaggatggatattttataccgcttaataatgacccgcaaatatatattcatggattgtctgcgccgatacaatcattagaaatacagttagatgacgcagagaatataaatgcccgaatttactacccagataaaaatggcgaattgaacgaacaaaatgctactggtttctatgtagacgagaatattttagttggaataatcccatacgcagagtatccttttatcagaatcgatatcaattctggtttccaattaaaagatatccggttcagtgcacaaccgcttgaacgttcgactttaaataaaacatttagttcaattcgagtgtcagttatattcttaattatttttgtgggctggatactttatgatcgttttctaaagaagcggaaaatgaccaatatgcaaagatccattgcaagatttaaaaagtttttttttgaaaagaaagtttataaatttttactcgtttgggcgcttgcttttactattgcggctatgacggaacgctttatgaggcgaagcgggacatacggattatatcgcctgatatttataggagcaattttaggtctggtgtccctcagtgttttttattggaaagaaatttgtttaagaccggaaacgatttttgcaatagtttctttggcaacaggtctggtactatgtattacattgccaagaacaacaggtgtgtcttgggatgacgaggcacattttgttcgttcgatgcacatgtcttattttggcaccccaaagataactcaagcagagctttcattggggaatataagccttcctcctgtttacgatgaagaatctattcaagttcaagcacagaaactggaacaaatgttttctgaaggggccgtggctgaaaccataccaaggccataccgaattaacacaggaattacctacttacctgcggcgattgggttatttataggacgattgctccatttaagatatacgctgatactggtaatgggacgcatttccagcttgctgttttacacgatcattgtctatttttccattaaaaaaacgcctgttgggaaaatgatcatgacagtttatgcattattgcctacgaatatatttttagcatgtaattactcctatgacacatggattactgcattgaccatgctttggctggcaatcttttttaaagaatggaaatgtaaagagcgaagtatgacaacaggaaaaacaatagtaatgctgagtatttttgtattggcatatattcataaagtcatttatggtgtattaggaattatttttttattaatgcctaaagaaaaattcgtttccccaaataagcgaaatagattttatggaatgatatttttagcgatttttgtattagcacttattggtctactggggttcgtggcaagtccagcttcgttcagtgacgtaagaggtggcactgatgttaatgctattgaacaaataaaatttattataggtcatccaatttcatatgcgtttatattgataaaacatttattttcttatttttcattgggatttagtcagaactatatgatgtctatggcatatatgggatatgtaaaatgccacttagagacaatagccttgctcacagcggtaatttttacagaccgcaacgagactgatattattattgtcgatggtaaatggaaaagaatttttgtatacctggcagttttggctgcggtaagccttgcctcaacttcagtgtatatatcttttactccagtaagatccgaagtaataaatggcgcacagggacgttatttactgccagccatactcccagcctttatattcttgggaacaggaaaaataaagaacgtcatagaaagatataaatacaattttatagtcacacttggaagtgccggaattctatttagcggaatatgggaatgttgtataagtaaatatatggttgcatagttaaacaattagaatttttaaacagctgccatcattatttttacagtatcatattacggtgaagcggcttgtttaaaaactggtctatagaagaagtgaataattgaaggagacaaaatgaacgtattatttttaaatttaccgtataaatttgatatcagccgggccagccgctggccggaaaaaacgaaatccgatacgttgtattatccgtattggctggcatatgcggcagggatgagccaaaaatgcggcttggaggtcaacttggtcgattgtattgtgcgtcactacaatacagaacaaacattggcggaggtaaaaaaatttgcgccggattatatcatggccgagattacaacgcccacgtgttatgaggattataaggtcatccgtgcgatcaaaaagacgaatccaaatgtaaaaatcataatcggcgggacccatgcgacggcattgccgcagcaggtgatggaggagtgtccggaaattgatatccttgttcggggggaatatgattttacaatccccgagattgcgcagggaaaggcgctggcagagattgcgggcatttcgtacaggaatgataatgaaataattcacaataaggacagagagtaccaggaagatctggatgagctgcctatggtatcaaaggtttaccagcagtttttggatgtcaatgactactgctatgcattcgcgcagaagccgatgattcagattttcagcgcgcgaggatgcccgtaccgctgcaatttctgctcttatcctgaaacaatggggggacaccagcttcgccgccggtctgtcagcaatttagttgacgagctggagtatattcataagcaaatgccggaaattcgtgaaattttcattgaggatgacacgttcactgccgataaaaaacgggtaatggaggtgtgcgacgaaattctgcggcgcggtcttaaattgcggtggtcatgcaacacacgggcggatctgccgtatgccgttatgaaaaaaatgaaagaagcagggtgccgccttcttgtagttggctttgaatctggaaatcagggtgtgctggatcaaactaaaaaggggatcaagctggaacaatcgcgcgcatttgctgaaaatacgaaaaagctgaaaatcaaagtatttggatgcttcatgatcggtctgacaggggattcactggatacgatagaagaaacgtttcaatttgcaaagtccatatatcccgatatggtgttttttcagcaggccgtgccatttcccggaacaggattttataaatgggccaaagagaatggttatctgattacagaggattattccaagtggctcaacagcgacggatatttaaactgccttgtaaactatccttatgcgtctgcaaaggaaatagaaaaaatccgggatcggttaatgagccgctattacttctcgtttacgtatgtttttaaaacgtttcttgccaacttgagctgggcggaatttaagcgggtaacaaaagccggcctggcctatataaagttcagagtgaaacggatggggaaaacatgatcaatttaatttataaggtgtattactgcatgccgcgctggattcagtcgctggtatcaagaattgtttataaacccaagctgggcaaaggcgtcaatttatacgggtggccggttttttcaagcaatgtctcgatcggcgattattcatttttgaagcagaaccaatttattcggaatgtgcgaatcggaaagttttgctgtattgcagaagggctttcagtcggattgaatgaacatccgtatcatagtttttcaagctacaggatgacgggaatggcgtcgccaatttccaaaaatttgaaacgggggtaaatggaaataactagtaaaacaacgctgattggaaatgacgtctggataggggattccgtaacgatcaagggcggcgttaccattggcaatggggccgtaatcggcagtaaggcgatggttacaaaagatgtgccgccatatgcgattgtaggcggagtccccgcacgggtgataaaatacaggtttgatcaacagaccatcgattttttgcaggcgcttagttggtgggattggccgccggagagaataagcagggatatcgatagattggaacgatttgataggggtttattgtgatccggatcagataaaagtggagcgatagcagtatgaagaaatgtttaatcataggagcctatggatgtggtaatcgaggagatgacgcaatattacaatctatttcacaacagctatccaattttcagattactgcaacgaatggtacttatgaagatatggcggagtatctttccattaaaaccataccctgccgtatgaatgaagggatatcattacccgtcgttttcagtatgataaaagacagtttctctatactgtttcacgtagtgaaagctgatgcaatcatatatggtggtgggagccttattcatgatttaacgcgttacaatttaccgtttttgtacttttggcatatggtggccaaaatattgagaaagaaagtatattatgccaatatgggcgtcggccccctgcgcacaaaaacaggaaaacaattaagccgctactttttgaagagggccgatggtgtttttgtaagagatgagcgcggattaaaaatttgtaaagacttaggcatttgtaacgccgttttagtatgtgacgctgcatttgcagtaacagatatatcgcccaataaaaacgatttattagcgcgctttgaattggaggaacggaattatgcttgtgtaacggtttcgggatggtttgaatcttctaatttttgggatagaaaacacattgattttaagatgcaaacggaaaaactagcgcaagagattaaagaattttataagattattaataaaaaattggtttttgtaccgaccgtcacttatgatataaaactcttggaaactttgaaggatttattggaagattgtgattgtattattattccaccaaattacggttgtgttgaaatggcggaaattatagcaaacagttatttattattcggaatacgtatgcattctattatatttgcagcgcgacgcgcaaccccatttatttctttaatttatgatgaaaaagttcaacaggtgttgcattttctcgatatggaggcatatgcctgtacaatcgggcaagcctctccggaaaaggttgccaacataacacaaaatgttatagatcattatacggaaattcaaaacaagcttaaaacgaaggcagatgccgcacgaataaaagcgctggaatgcctaaataaaattcgatctgatttggaagccatatgaacaaaaaaggagttatttggaattcgcttggcagcctcatgtatggagccaacagcttcatcatgctggcgctggtcagccgtgttgggacagtggaacaggcgggatattttgggatcgccttcacgacggcgcaaatattgtacatcgtcggcctgtttggcgtcccgcattttcagatgacggactatggggagaaatacaggttttctgactatattcatgccagacggttttcctgtttgttgatggcatgtggatgcgcaatcgccatatggggatttcatttcaccggtgcaaaagcaagctataccgtctttcttacagccctgatgctgctgaatgtgatcggggaattatatcagagtctttttttccagaaaaaccgtcttgatctctccggctcggcattgttctatcggactctctggccgttgctgctgttttgcatcattttgtgggtgacacgcagcattattgtcgcgctgtccgtacagattttggccaatctgttccttacaatctattatgccgtatgggtcgcgccccggtttatttcagcgcaaccatgcgacagagcgtcaggacaggtgcaaaaccttctgatggaatgctttccgctatttgtcagtctattattgatgaatatcgtaatcaacgcttccaaatatggtatcgaactgatgatgaatgatttggcccagggttattacaacatgatttttatgccggcacaggttatcaatttgtgcagccagtttttgttcaagcctttgctcaaccggtattccaaactcctgtcggagagacagatccggactttcggcatactgcttctgcgtcaaatagttctgattgccctgttgacgtgtgtgtgttgtgcgggtgcttacgctatgggaatcccggtgctgtccctgctgtatcaaaaggatatttccgcattgcgaatccatctgattctggtggtgttgggaggaggcatctttgccgtctgtcagttgtattattatatattcgttatcctccggcgacagaaatggattatgaaaatttatttgtgtataactgtggtcgccgtaccgacgacagccgtatgtgtccacagcgctgggcttatgggtgcggtactttctttcgttatccttcatgcaatacttgcgctgtgttataccgcgaggatttacgctgttttgaggagggagttttgtgcctgaaataacagttgttattacctcgtacaatcttgaatcatatatagcgggttgtttggatgaattgtttggacaaagctttcaggatttcaatatcctgattgttgatgattgttccaaagaccgcacggttttgatgatacgggattatcagtcgaactttccgggaaggctgcgcctgattgagcgggaaaaaaatctgggcagtcctgcacggacgcgtaacgcagcgatggacagcggattcatcgacggccgcttcgttatatttttagacggagacgatcatttggagcctgatttcctggaaaagctgcatactgccgcactgcgtaccaacgctgatattacgctctgcggctacgaccggatcgatgaacaaacaggacgcgtgctttgtacggaaatgacatcatttcccatcctgctgcatttgccgccgcaggatgacagtttatgtttcattaatggctctctctggaataagctgatccgtacagatttaattggcaatacgcgtatacctgatttcaaggtgggggaggatgtatccttccttcaggctctgtacgcaaaagcggtatcggttgccggcgtgcaggacgtgttaatccattacggcgtgcgcggcggttcggtaatctccaatacgcagccggaaacgatcagggcgtttgcggacgagcttgcacaactgtatcaagcacagcgcgaaccggtactgcgtgagaatttggcgcttttggcgtttatccatatagggatttcgatggcggcgcgtgcgtatgacaatccatcggttcaaataggtgaacacttgcgctggacaaggcggtatctttatacgcagtttgacggactgcgcacttgccgctttttgcggctgccttctctggtccggcatggggtcaagggatatgcgctctatatatgtaaactgttgtacaaatttcattgtttcagcttattcttatttttatatcggtttgtgcggcggttgctgcatgtggattttaaattttaaaacattgcctgtgtaattgggggataaggatgaaaattctgatcgttattccggcttataatgaagcggaaaatattgaacgtgttgttgaaacgctaaaaaagcaatttccaggggcggagtatctggttgtaaatgactgctcaaccgaccatacagttgaaatttgccgagaacatcattttacatatcttgacttgccaatcaatttgggattgagcggggcttttcaagcgggtcttcgctatgcccaaaaatatggttatgattgtgcaatccaatttgacggagacgggcagcaccgttctgaatatatagctgaaatggctgaggtcatgcaggaacaaaaaatggatattgtcattggctctcgctttttaacgcaaaaaaaaccgcatacattgcgcatgttgggaagcagcctgatttcatttgcaatccgtattacaacagggaagcagctcacagatcctacatcagggatgcggatgtttaatcgcaagctgattacagagttcagtacccgtttaaattacgggccggaaccggatacaattgcatacctgctcaggaacaaggccagagtgcaggaagttcaagtatccatggatgaaaggatagctggagaaagctatttaaatatggcgcgttctatccgatatatgatgaatatgttaatttctattttgtttatccaatttttccgagtgaggaagtgacttgaagtgtctatagtgctgcgaataatattaatcatagtttctattctaaactgtggatggattttaaaacgaatacaaaaatcacaagtcaaaatagaagattctatattttggattttattttccggatttctgatttttataagtatatttccggggatcgtagagtatggagctaaattgaccggcattgcatcgccggtaaatttcgtgtacctggcaattatttttatcttgatcttaaaaattttccgtctttcaattcgtatatctcaattggaaagcaaacttcaaacgcttgctcaaaaatatgctttagatcatatagaaaaagtataaccgctttttatacagtgttgacaagccgctccgggtcacgaagcctggagcggtttgttttaatatatggaagctttacaagacagatacggtaaaatataataggaattacggaggttaaggaataaataaaacagtttatgaggagtatcaatggacagcttgaacaattatatccattttatccaggaggccgaaggcctcaaatgcatgacgcgcacggcttggacaagtacaggccggcgtgaaagtacagcagagcattcctggaggctggcgctgctggccgggctgctgctgcccgcgtatcctggacttgacgcccggcgggtgctgatgctctgcctggtgcacgatctgggcgaggtgtacgagggggatatctctgcggctttgcagccggatcaggatgaaaaggagcggcaggaacgcgcggctgtcgaacgggcagcggcgctcctgccgaagacagccagacgggaagtgtgcgcgctttgggaggagtacaacgcctgcgaaacgccggaggcgcgtttggtgaaggcgctggataaggccgagacaatattgcagcataaccagggcgccaatccgcctgaatttgattatgccttcaatttggagtatggtaaaaaatattttgaatacgacccgctgctccggaatctgcgcgcgctcctggatgaacagacacgcgaaagggtgttgaaacaggaacagcgatgctgaaacgtaaacgcccgcgctgccaaaaggcagcgcgggcgtttgaaatgcgggggaggggagcgcaaatcacgatttttgcgcacgctttttattcatgacaatcagaaaatccggaaggcggaagatttcaaggctggcggaccggtcaaggttgcggatatggtggcgcatatgtccctccgcacgcgttgatatgacaagatcacatttgtcatcgccccgctggagaatgctttgacgaatgttgatcagcgaaattttatcataagaaaagactactgtgtgtaaatgatagagctttgaataacgtaatgtataataattttcgcagcatgagacgccggatgaagcgaaatcgagcagcctgacgcccaaaaaccaaaaggccggcagacagagcataaagcctgcaaaacgaatgatttccacccagcttggcagaagccagcaggcggcaatcgtaccagcagggatcagaaggcagggccagagcggttcgatgataaatttaaagattgcgccgccatttggcttgagtgtacgctgcgaaaggcggtattccgggagcagcaaggccaggcgcttttgcgtgcgctttttggaggagaaagggatgacagccgcgatatcggattttttgtccttggcgaaaccgatcgcgttgatatagacggaatatagacgcagaaggcgcgttgtcaggctttggcggatatcgataaagctcacgtcgtcgcgccgcagagaatattccttttggacgagcacgccgccgctgacatggagggtgttttccgagcggcagacaaacaggtttttgacctggagcaggctgatacagaaggcgacaagccatccgcacaacaacaaaagcgcggcgcccgcgaagataggcggaagaccaaaggcgatccggcgggacagctcctcgaaggttgtaaccaggataccggacagctcctcgccgagaatttgccccatatgtgaaaaaaatgttgcgatgaaaacaatgccgatgaaggaattagaggttaaaagcgaaagcagcacaagctcatagaggtgcggccggtcctgcgcgggggcgccgtccgaatccatggccgggggagcggcccgcagcgaagaaatgcggtcggcttcacgcgaccagacataaaaggcggcgtcgggactgcgcggatcgcctgcaatggtatcgatgcgtatacgggcaatgcgaaaggggcgcagccaaaagggacgtattacagaaagggttgaaatacggtcctgagggatgtaaaattcactgcgaaaaaatatacccgttgcaatatatacgccattaatatccatatggtattgaaaatgctcccacttttggtaggccagaataataatcagggctacaatcagaatatcaaaccaggcgccgcgcacccatgaaaagatatcgcctgtcagcgcgctgataaagccgcgcgccaaggggataatcagaagaaacaggaatcgatataaaaaggtgagaatggaaaaagggtgcgcatggatagcgcgcgcgcgaacatcagacatcaccggctcctccttcctgggcggcgctgtgcgggcggcccggagtcagaagcgtctgcagctcccgcgcgtcctgcggggccagacccggaatgtagacacggcctccagccgcgtagacgaatagggaagtgacgccgaacaggcgctccaacggggttgaaaagacagaggtatactggatgcttgtaaatggaacggctttcacacgcgtataaatgacgccgcagtacacaagcaggcaatgcgcgttcgtgccataagccagcttgcggtattttatcggataatagaatatgtaaaagtacagaaaggcgcacatccaggcagccgtaaaaagccaccacagccaattgacgcggggcgaaaaccatgcggtcaaaaacgagggcacgagcgcggccgccaaaagccgcagccgccaaacggtcaggatatgcaggtcaggtttttttaatgtcacaaacggccgcctttctaccacatcggttttaatggtatatcctctattatataggaaaacacagggaaaaaacagagtatttttgcagaatattaaactaatagtatagactataatcaattataccattttagcgcccggacagatcgtaaaaacctgaccgggcgcctgtattttggaaggctgatgggaacagcttctagctgcaaaagagatgagcgccaatgcgtttgatcaccggacgtgtccgaatccatttgtttgacgtcttgtcgggattgtaataatagagcgcgccgcccgaaggatcggagccggccaaagcttcgcgagccgcttttttggctgattctgcgaccgcttcgttgatctggccgtcggtgatcgcggtgaatgcgcctggttgatagacaacgcccgaaagcgtgtcggggaaggagggatgctccacacggttgagcacgaccgcccccacagcgacctgtccctcaaatggttcgccgcgcgcctccgctgaaatgatgtttgcaagcagggcgatatcgctgctggaataaccgccgctgccgcctgtctgctgcgaggattgaatccccattgcttttagggtagcgttgccggcgattccgtcaactgtcagtccgtttttgcgctgaaacgacataactgcctttttcgtttctacaccgaagattccatccacttcgcctgtataatagccccagtttttcagacgctgctgaatttggcgcacctcattgccgcgcgagccagtcttggaaagcacgctttccgtttgaccgccgatgcgcgccatataaagaatcatcgcgccgagcagcagcagcgcaaaggcaagcgataccgtgcggaccacaatgacagcacgcgggatataaccgctttgtttggacatgaaaatgcctcctttgagtggcctgatagttgcagtatgtgcggtgacgccgtctttatacatatgtaaataccgcgtaaaatgtagctttccaagaaatttcgactttttttaaaaaaatgctaaaaagtagttgacaagcatggcagagtgtggtattataacaaagctgtctcgtgcgaacaacacaaacgccgatcaaacgacagcgcacagcaccttgaaaaatgaacaacgagaaggaaagaaccgaagtgaaaccggaagggcttgagaaagtccggaagggggaacacagaagttaagctcagttgtgccgacaatacttggcgggtgactgcctggaaagataggtctttgccagcacaaaagacttcgctaacagcgaggtcttttttcttatatgcagtgtcgaaagcgatgggaatttgttgacacctcatataaattatgttatcataaccataatttgtttgaggggtgaagatgttggaaaacaattcagctaagagcaaagggatcgcctctctggtgcttggcatcctttctcttattctagtctggtttggcgaaggtacgctgctcgcaatgattttaagcatcattggcattgtttttgctgtgggagcgcgtaaggagcttgcccctgatcagggacgcggattggctacggctggcatgatttgttcaattatcggccttgttctttctacgctttggctgattgcttgtgtattgtgtgtcggcgcgtttgcttccaccataggcgccgcaatcagttaaaatcctttctatgatcggttcatggcaggcgtatgaagtggatttgcctgtcgggttcgcggtttcatttgcgataagggaactattcaaaaacaggccgcatttgcggcctgtttttccattgagggaatatgaaatgatgccatttataaaaatttatcaatattcgattccgtcttattggctgatgtgtatgctcggactgcttgcctcctgcattcttttatatgccaggcgcagacgtttcaatattgcggcggacgatacgctgcatattgtactgttcggagtgatcggcgcgatgatcggcgcaaagacgctttatctgattacaattgctccggagctgctgcggcacgcgtcagaaatcgattggtcctatcggacgatagaactgcttttttctggcggttatgtcttttacggcggcttgattggcgggttcttggctgcggccgtttattgctgccgttatcgaatcagcctgcgggctgcggcggacttttatgcgcccgcgctgccgttgttccatgtgtttgggcgcattgggtgctttctggctggctgctgctggggaatcgaagcgccctggggcgtcgtatatacacactcgctggccgcacccaacggcgtaacattgtttccggttcagctcacggaggcggtttgtaatcttgcgatctgcatggttttacttttgcgtgagcgccgtcttagcggcaggcagccgactggcggcgcattgcttctctatgcggcgctttatacctgtgtccgttttctgctggagttttggcgcggcgacgccgtgcgcggccatttcctgttcttctcaacatcgcagtggatttccgttctaatcctctttgcaattggtatttatttttggaaaattgtgcgcagccggcaattataagctttctgtgcattgcgtgtgctgtcaaagcatggtatactttatcctgcacgaaagtcagaataaaattttaattaatttaacaggagctgcaaatgataacagtcacaaatgtaagcctgatgtttggaggcacaaaactgttcgcaaacgcggatttaaagtttatgccgggcaactgctatggcatcatcggagccaacggcgcaggaaaatcaacttttttaaaaattctctccggggagcttgaaccgaccaccggcgaaatttccattccgaaaaagtgccgtatgtcggtgctcaagcaggatcagtttcaatatgacgaatatccggtcattgatacggtgatcatgggcaatccgcgcctgtatgaggtgatgaaggaaaaagacgcgctttatgaaaagcctgattttaacgatgaggatggcgcgcgcgccgccgagctggaaggcgaatttgccgaaatgaacgggtgggacgcggaaagcgactcggggcgcattttgcaggggttgggcattgcgcctgagctgtacggcacgcccatgggcgaactcaaaggcggcgacaaggtaaaggttttgttggcacaggcattgtttggccagccggatatcctgctgctcgacgaaccgacgaacaacctcgacatcaaatcgatcgactggcttgaggatttcctgcttgattttccggggaccttgatcgtcgtgtcgcacgaccgccatttcttaaataccatctgcacgcacatcgtagacatcgatttcaatcaggtgcgcatgtatgtcggcaattatgatttctggtatgagtcgtccaagctgatgcagcagattatgaaggatcaaagcaaacgccgcgaggaccagatcaaggatctgcaaaactttatcgcgcgcttttcggcgaacaaatcaaaatcgaaacaggcaacatcacgccgcaagctgcttgagaagctgacggtcgacgaaatgccggtttcgtctcggcggtacccgtgggtcgccttcaaacccgaccgcgagccgggtaaggagatccttgaaacggacggaatcaccatgacgattgacggcgtcaaggtgctcgacggggtgacgttccgtgtcaaccgcggcgacaagatcgcgtttgtcggcgagaacgaacaggggcagacagcgcttttccgcattctgatggatgagctgaaacctgatgccggctcctttaagtggggacagacaacctcgcaggcgtattttccaaaggataattccgccttctttaacgacagcgagctgacgatgctgcaatggttcgcgcagtattcgcccgacgatacggagacgtttatgcgcggatttttggggcggatgctcttttccggggacgacgtgtataagcctgttaaggtgttgtccggcggcgaaaaggtgcgctgtatgctttcgcgcatgatgcttaccggcgcgaatgtgctgctgctcgaccagccgacaaaccacctcgatctggaatcgatcacagccgtcaacaacggcctgaccgattttccgggaatcgtgctgtttacatcgcaggaccatcaattcattgagacgatcgccaaccgaatcattgaaattcatatggacggcactattacagatcgtacaatgacatatgatgaatacagagagtggaaaaaagaacaggagaatgtgaaatgaaacgtttgttgatagctttcatggctgcctgcctgtttttgacggcagggtgcggggcaggtacggcgccctcggcggccgaggatgtaccggcgccgtccgccgcggcttcaagcatggacgaaaccgcttcctcacgcgctgcggacgccgcttcgcaggcggccggcgcaccggaaggctctggcagcgctgacgcaggcgctacgattgagatcgatgattctcaggcaccgactgcctcctgggagacgcagacctttacaagcggcccgttcacctttgaactgccggccggctggaaggaatacggcgacatgggttcgtataccgccatgttctttacggatgcgtctgtggacatcgcgtcgcagccgtcgaatgttgttgttgagatcatgccgaccgagccgcaggagggcgtcgattatgccgaccctgctgttcaggacagtttctttgaatatattgaagcagactatttgccgccgcgcagccccgaaaatgtggcctattccatctggaacggcgcggccggcacagcttatgtcgtttcgtttgaccgcaacgcagacgatggccgcaccgcgcggcaaacggtctattttctcatggggctgcgtttcccggtcattgtttacgcaaccgattttggcgaggggatgacgccgcccgtcgacgatatcgcgcgccgggtcgccgcgaccttccgcatcgacgagaatttttcgctgccgcaggcgtgagaggcggattgctccataaaaaagccccccgcggcggcgcggggggcttatccgtttcaaacgccaagtcacatgcaatgaatctgccagccgccgtccgggccgatggagcgcatcgcatcggtgacggcatcgagatcggcgagggaaaaacgaacggaaatgccgcaggaggccgtgacggaacgcggcgtgggcatcatcacgatggaaaaggcgtcgcgcaggcggcgttcggcctgcatagccaggtgcgctgattcaaaggcgatgacaccgtaaccggtcacagggaaatcaccttgccggcctgcttcatgcgctcgacgatctcatacatattgctgaccgtgccaacctggagctgttcggcaagatggtagaaattcaggcaggtgccgcagacaaggatctcgacgcccttggacgacagctcccgcaggtgcccggcaatctgctcgttatgcacgggaagttttacgccgccgttcataaacaggatggaggcaggcaggtcgtccgactgtgtgagcgtgtaaaaaaacatcttcataagcgacgcgccaagctccgggtcgccgtcgccgatgatctcgcggccgacaaatacagaccacttccccgaaggcgccccctgactgatcaccgcgttggccgcggcgcacggctcgcacggagccttggtaaaatcgatggaaaagataccgccgctgctttgcacagtggtccggaacccctgactatccgccagccgctgaaggttttcaacagcggtcgcgttgtctacctcaatggtaaaggcggacaggccgccgtcaatttcctttttggccataacgaccggaattgggcagttttttcctttggcatcaatcagtttgctcatatcggttttcctccatttcaacgccgcgcacacggatttcataagacttttacgctcccgccgcccgcgcgtttgatccagcggtggggccggacgctttcaaatcctattgtactccaacagaggcggattttcaaccgtttacgcagagagcgccattttcccctatgcaacgccggtgaaatggtgtatactttgtctgttggcaaagcggccccgcatagggctatttacaaggagcgatccagatgaatatacttgttgtgggctgcggcaaggttggttcgcagctttcaaatattttatcaagcatggggcacgatactgctgtcatcgatccggacccggcgagctttgaacgcctgtccgacgatttcaggggctataccgtggcgggtgtgccgatcgatcagacggtgctgcgcagaggaggtattgaggcgtgcgacgcgttggccgcggtcacagaggacgacaatacaaatgtgatggtctgccagcttgcgcgcgaggtattccatgtgccgcgcgtgcttgcgcgcgtttttgatcccaggcgcggcgatgtgttctcacagtttggactgccgacagtctgcccgacaaacctgtcggttgacgcgatctacgcgatgctaacgggccgggaccagatcaaaaatgtatatcttgattcagcaaccgtctcctttgacaccaggcagccggacgccaaacaggtgggtatgacgcttggggcgctttgcggcgccgacgacgcgcatcatgtcctgtttgggctgctgcatgaggacggcaatctcacattggcgtatgctggctcgcggcagccggttggaccgaacgaccggctgctgtacgcgagggtaatcgattgacagggaggcgtggctttgaatgcagatcattgttgtgggcggcggcaaggtgggctattatctgtctaagacgctgctggagcatggacacaggccgcacatcattgaaaaagaccgcgctctgtgcacgcggatcgctgacgatctggacgtcgcggtgatctgcggcgacggcagcacgcttgatgtgttggaaagcgccggcgcaaaggatgcggacgcgctgattgcagtcaccggacgcgaccaggacaatctggtcgcttgccagcttgcaaagcagcttttccacatccagcgcacggtggcgcgcatcaacaaccccaaaaacgccgcggtcatgaaacagcttggcgttgatataccgatttccgcgacggacaatatcgcgcgcctgttagagcgcgaggtggacgcggccgctatccggcagctcatgccgctcaaccgcggggaggcgtcgctttccgagcttcagattccgccggattaccggcgcagcggcgcgcgcctttccgaactggacctgccggaggaatcggttgtcgtatccatttcacgcgacggccgtttgattatcccgcgcggcaacgcgcaggtgctttcgggcgaccgcctgcttgtcgtttgtacaaacaccgtggtgcgtgaactgatgcgaaagtttgatcttgaacagccctcatgaacagccggcttgaaacgctcatgcgcggtatggcgttcgacgaatggggtgtctgccgctttcacgacgcgctgccgctgcttcccgtgcgttcaaaagcgcgtatcccgcagggggcgcgcagcgtgattgtcgttctgtttggatattatataggtgattttccgaatcgcaatatatcctattatgcaattgttgacgattatcacaccattgtgcgcgcagtgctagaaacggccgcggacaagcttcgcgcgctgtatgcggacgagcagtttgtaccgtttgtcgatgcgtccccggtggcggaggttcgggccgcctgtctggccgggcttggagatatcggcatgaacggccagcttctcaaccggacgtatgcaagcaggtgctttataggcgaaattgtaacgacggcggcgcttgagccgtcccggcgcgccgcgccgctctgtacgcgctgcggccgctgtatcgcggcctgtccgacgggtgcgctgcgcccggacggctttgaccgtgcgctttgccgctcgcacatcacgcaaaaaaagggggcgctgaccggctgggagcgcgcccagatccgcagcggcggtttcgtatggggctgcgaccggtgtacagacgcgtgtccggtgaaccgtctggctcagaaaagccgtgtgcccgcgttttacgagcatcccgagccggttgtgcacgccgacaatgcagcccgcctgtgcggggagaaggcgtatggctggcgggggacgccggtgcttctgcgcaatttggagatcatttgcggggatgcgcgggacgatatggacacggacgcccggcccagcccgcccgcagggcggacgtaaaaagatggggcaggcagaccgccgtcagaaaggttgaaacagtatggagattttgacgccggagcagtacggcgaatttgaagcgtttgtatcggcgcatccgcagggatgctttacacaaagcgtcaattggcagaaggtcaaaaacaactggggatatgaggcggttgtgtcgcgaacggccgacgggacaatacagggcgccgtatcggtgctggtgcagaaaattccgttgatcggcacgtcgtttctgtacgcgccgcgcgggcctgtgtgcgacctgcatgacagggctgtgctggccgatctgaaggccggcgtcgacgcgctcgcgaaaaagtatagggcgcatgcgtttaaaatggacccggatgttcttatgagcgatgcggagtttatcaggatcgcaaaggatatggggtttgtgcagagctatggcccggacggctttgaaggcattcaggcgcgtttcaattatcgcttgtacctgaacgggcgcacggaggacgagctgtttgcaaacctgacgcaggggacgcggcgcaaggtgcgcatcgcaattaaaaatgacgtgcaggtgcgaccggtgggtccggaatacctcgatgaatttgtgcgcattatgcgtgtaaccggcgcgcgcgacgggttcaatgtacgcccccgggcatattttgagcggatgctggatgcgctcggagagcatgtgcggctgtatatgggcttttatcaggggacgcctgtctgcggcgctgtaacgacgaattacgcgggcaaatgctgctacgtgtacggcgcgtcggacaacgtccaccgcgatgtcatgccaaattacctgatgcagtgggaaatgatcaaatgggctgttcagaccggctgcgaggtgtatgatttccagggcgtttcgggcgatttggagggcggacatatggcgggactttatcagtttaagcgcggcttcaacggtcagcttgacgaattggccggagaattcgattacacgtataaacccatcaaggcaaagctggttgatcgcgcgatcgatctgaacggtaaactcgggcagctcaaaaagaagctgcgccgctcatgaatacgccgctgtatgacgccatgcggctgtatattgaacaggaccgcgcgcgttttcatatgcctggacacaagggaagggggaccccgccattttcagaaatcctgccgtgggatatcaccgaggtagcgggcgcggacagcctgtatcatgccggagaggcgatcgatgcgtttgaacgcatcgccgcgcaggtttacggcgcgcggcgcactctgctctgtgcgggcggcgcgacgctctgcatccagacgatgcttgcacttgcgtgcggcgcgggcgggacggtggtcatgggcagaaacgtgcaccgcgccgcaatcaatgcggcggccctgcttgaccttacgcctgtatgggtgatgcctgacggcagcgccggagcctggttttccggccggtacacgccccaggcggttgaagcggctttggccgagcatccggaggcgtcggccgtttatatcacgtcgcccgactactttggcgttatgagcgatgtggctgcgatttctgcggtgtgccgcgcgcggggggtgcctctgctggtggacaacgcgcacggggcgcacctgccttttttgccggaacggtacggaaacatgcatccaatcgcgtgcggcgcttcgatgtgcgccgacagcctgcataagacgctgcctgcgatgacgggcggcgcgctgctgcatatttcgcaggagcggtttgccggggacgcaaagagcatgatgtcggtgttcggttcgacaagcccaagctatccgattatgctttcctgtgaacgggccgtggcttatgcggccggcggtgcggccagggaagggtttgatcgcacggcgcgcgcctttgacgcgctgcgccattttgcgctgcaaaagggctttgccctgccgcttggcttatccgacccggcaaagctgtcgctctgttttggcgcgcgcggcgatcaggccggggagttcggcgcgcatctgcgcatctatggcgtggagccggaatatatcagcgggagcgcctgcgtattgatggcggacggagaaaacgacgcccgtgattttgagcggctgcgcgccgctctcgacggcctgcggccgccggtgggacgcgtcgcgccgcctgcggcgccaaagctgcccgagcgggcgctttcggtgcgcgcggcgctgttttccccgcgcgagcagattcctgtggaaaactgcgcgggccgcgtcgccgcgtgcgattgttccccctgtccgcccggcgtcccggtcgtcatgcccggcgagcgcatcgacagcggcaccgccgcggccctgcggcgctacagcgtccgcactgtctgcgtcctcccgcttttttgaaacttaccttttttgaaaaaaaggtaagccaaaaaactttagtcggctgcgccgcaaacagcgggacaggatccggcaatttacacaggctgcgccgcgaacagcgggacagaggagccgcctgttttgaccaaatttgggatgtcctttttgacaagtccttcttgacgacgcgaaagggttggatttcgacgcggcttgtgctataatatgcgcagtgcaaacagaaaagctgtttgcggccgccggacggcggcaaccacccgcgccatgtgcggcggccgatcaattggagggcgactgtatgaagctgattttcgcgattgtttcaaacgacgatagttcgcgtgtatccaaggagctgacaaaaaataaatactcggtcacaaagctggcgacaaccggcggctttttgatggcgggcaatacgacatttttgatcggcaccgacgacgaccgtgtcgacgatgtgatccgcatcattgggatgcactcaaaaaagcgcacgcagatggtgccgtcctcggcctcgtacggcgtgggcatgtacacctcgttcccagtggaggtgcaggtcggcggggcgacaatctttgtaaccaatattgaacggtttgaaaagctctgatgcaaaagctgctttataaccgccgggccggcgccgtgttgtccgggctggcggcgggcggccggtttccacatgcgctgctgcttgaaggaccggccggctgcggcaaaaaaacagccgccgccctgatcgctcaggaacggctgtgtaccggcgcgccgcggccatgcggcgtttgttccggctgtataaaggttgaaaaaggcgtccatccggacgtgcgcttttataccgtgccggaggggaaaaaggaatttcccgtcgagcttgcgcgcgatatccgtcaggatgcatatattgcgccgaatgagggcgcgtgtaaggtttacatcgtcgatcaggcgcatacgatgaacgcgtcggcgcagaatgcactgttaaagattattgaggagccgcctgccggtgtttactttattctgttgtgtgaaaaccgggcacagatgctcccgaccattttgtcgcgtgttgtttctgttgagcttgaaacgccttcgcccgacgaatgcgccgcggcgctcgcctcacttgagcctgacgtacccgaggagcagcggcgcgctgccgcggctggagccgccgggaatatcggacaggcgcgcgcgcttttaaaaacagcaaagccttcgaaggctgcggctgacgcgcgcctgctgcgggaggcgcttgtgttcggcgaccgttatacggcgctgcgtattctggcggcatatgacaaggaccgcgctgcgcttggccaaacgctggcgctgttgcgtgaaggatttgcccaggtagcgcttggccgtgaaacggatgcgcgcttttccaaccgcgtttcgccgggtcaggcggtcgctgccgcgcagatcgtacaaactgcgcggcttcgtgccgagcgcaatataggcgtgcctttgctgtgcgcgtgtatggttgaacagatcaaatcgacgcttggctgaaccggcgtccggccgtttgagcgtctgcgcgaatagaccttgaaacggctttgaaactggaggaatagaatggctgaaattataggtgtcaggtttaaaagcgtgggcaaggtctattactttgatccgggggacctgatgattgaaaaaggcgggcatgttattgttgagacggcgcgcggcgtggaatgcggcgaggttgcaatgggcaaccgcaccattggagataaagaggtggtcaagccgctcaagaaggtgatgcgaatcgctacgccggaggatatgaggcgtgtcggcgaaaatgcggcgaaggaaaagcatgctttcaaggtgtgtgaagaaaagatcgcgcggcataagctcaatatgaagctggtcgatgtggaattcacatttgacaacaacaaaattctattttattttactgcggatgggcgcgtcgattttcgtgagcttgtcaaggacttggcgtccgtgttccgcacgcgtatcgaattaaggcagatcggcgtgcgcgacgaggcaaaaatgctcggcggcatcggcatctgcggccggccgttttgctgttcgacctttctcggtgaatttcagcccgtatcgattaaaatggccaaggaacagggtttgtcgctcaatcccacaaaaatttccggcacctgcgggcgcttgatgtgctgtttaaaatatgaacaggccgcctatgaggatctgttgcgcacaacaccgcgcgtcggctcagtcgtgcgcacgaaggaaggccgcggaactgtgattgaggtaaatcttttgactggtatgcttaaggtagcgccggagaaggatcaggccgccgctaaattttaccataaagatgaagtgcgcatgatccgcgagggtcatgagcgcgcgcaggcaaaggatcaaacagaggaataaaaacgcaggccacgtttttttgatttgccagaaaactttacttgtattttcacttgcattttcgcgggactgtggtaaaataggcttgtaacatcgcaagttgtgtgcagtggtgttatacgcgcagtgcgcgttcggaaaaagtattttttttttggaggtgttccccatggcatatgttatcggtgatgcgtgcgtctcttgtggtgcttgcaaagatacctgccctgtcggcgcgatttctgagggcgacggcaagtacgagatcgatccgtctgcttgcatcgagtgcggggcctgtgcggctgactgcccgagcgaggcgatcaagcccgaataagggaccggcgtacataagaaacaagccttcgctgttaaagcggaggcttttcttttgcaaggggaggggctgtgtggacacatttgaactgtttgggacgatccggctgtatgtttcaggcacgcacaaggttggaacagacgcgctgctgctttcagaatttgccgctccgcgcacaggagaatgggcttgtgatctgggcagcggttgcgggacggttgcggcgcggtggttctgcggcgggcagccggcccccgcacgcgcatatgcagtagagcttcaggccgacgccgtccggctgatggagcggtcggttgcccatggcggcctgcccgccggtcgctttattccggttcatgccgatctgcgcgccttacaggatgtattgccggccggagcgttcagccttgtgacctgtaacccgccgtataaagctgcgggccgcggccttctaagcgaagcgccgggcgcgcggaccgcgcgccatgaaaccgactgcacgctggaggatgtctgtgccgctgccagccgattgctgcggttcggcggcaggctgtgcatatgccagaggccagaacgtctggcggatgcggtctgcgcaatgcgcgcgcacggcctggagccaaaacgcctgcgtatggttcagcacagcgccgcccatgcgccctggctttttttactggaagcccgccgcggcggacgcccttccatgaccatcgaacctcccaagcttttttgacgcgccttccggcctttttgaaaaaagcctcggcaaaaaactttccggcctttttgaaaaaaggcctcggcgaaaaactttaatcggctgcgccgcgaacagtaggacaggtttcgggatttaaacaggctgcgccgcgaacagcgggtttggtgctgcgtttatacaggctgcgcttgcccagccggctgtgagcggcccgcaggccgcaagacacccgtccataggcggggcttgcactggcaaaagtcatgacaggcgccgggtttccggtcttttacttccaggaggggattgcatggagcttgtaatatttgagccggatatgcaggaggccgtatttgcatttttgcaatcatgcattccaaaaacaggccgcagctttgagccgcggggaagacatgccccgctgacgcgaatcagcgactcctatgggggggctggccagagattctggtgtctgcgggacatgcaggggcatgtcctgggtacggtaggcgtgcggcgtgcgcaaaaggatttgtgtgagattaaaacgctgtttgttgacggcggccagcgcggccggggatatgggcggcgtttgcttggacgcgcgctgtcctttgcggcgcagtcaggctacagacgggcggcgctcgatacgagggcgcaggataccgcggcgatcgcgctgtataaaagcgtcgggttttatgagacaacgccgtatcacgacaatccgtacgcggatattttcatggagttgattttgtagcaaacgcgtctgatgaagtataaatatggaaaatgacgcttaattgaggaagctggaggacggatatggcggggaaattatatgtggtcggcacaccgattggcaatttgagcgatctgtcgccgcgcgcggcggatacgctgcgcgccgtcgattttatcgcggcggaggatacgcgggtgacgctcaggctgcttaaccgcttcgagatcaaaaagccgatggtcagctattatgagcacaatctgcgcgagcgcgggcagatgatcctgacgcggattttggacggtgaggactgcgcaattgtgacggatgcgggcatgccgtgtatatccgatcctggggaggatcttgtccggctgtgcgctgaaaacggcgttgaaacggtggttgtcccggggccgagcgcggcggtcgccgctttggcggtttcaggactttccacagcgcggttttcattcgaaggctttttaagcgtcaagcgttcaagccgcatggaacatctggagcaggcgcgcacgcagactgcaacgatgattttttatgaagcgccccataagctgtgcgcaacgctgcgcgatatgctgtccgccttcggcgaccggcgcgtcacgctggcgcgcgaactgacaaagctgcatgaacaggtgcacaggacgacgcttgcacaggctgtacaatattatgaggaaaatccgccgcgcggcgaatttgtactgattgtggagggcgcgcggccggcgcgcgatgaggcggctggttttgacgaggcggttggcatgcttcttgagcgcgcgcagcagggcgcgccgctgtcacaggccgcgcgcgatattgcaaaacagaccggccacccgaagggcgcgctttacaaagcggcgctcaaacaacgggggccggccggcgatgaggatttataaaagcaggtaggcaagcgcgagcaaaaggacattatcggcgtgctcgttataaagcaaaaacagcaggccgatgatcagcagggtttcgctgtcgagattcagcccatccagcagtccatgcagcggatcgcccgcatgtgggggggattggttcgatacaatttcggattgcgcctcgatgggcgtgttgtccgcagagatggcggctgattccaccggggcgggcaggtcgcgaatgtcggatacgggcacatcgtaataggcggccgcttcccgcgcgcgcgtctgaaattcatgcacacggttgaccgcctcttgctgcatgcggatcatatcctcctcggtatacgtctttgtactgttccatcgcatcatttcgatcgattcccccctgagaaaagattgccgagactgccgagcagcccgctgtcacggacgctcggccatgcgtgaatcaactgcatgatccgcacggcgtcgtcaattttactggcgcgcgccggtgaaaaatgcggtttgagcgcgcgcagcaattcgacattcttatcgctttggttaaaggaatttaaaatccctgtaagctttgagatcgcgccaagatccggcgtggcgcctgtgccggacgccgcgccgccagcgccgccgtttccggcattttgaaagttttgcaggatcgaggcgatggcgtttggatcgataccgccgccctgtccattggattgcccgccggcgggcgcggcgtttgcggcgcccgcatccgacgcgcctgcgccaggcgcgcctgtgcccggtccgatgccaagcgactgcgcgacttggcgcagttgttccatcttggccgggtcgcccagaatggcgctaagtgtcgaattcagatcatccaccgtctgcatctccttatccgtgttgttcgattccctgtgcgcccggtatggccggatggcaaaaggctacggaaaatcatcaaaaaatggtcggtttcatttgcccatcaggccgcgcagaagctgttggacctttggattctgtacgagctgttgaatcgccgccggattctgcatcaagctttggatacggtcgcgttgcgcgggcgcaagcccgctgagcacgccgctcatatctccgctttgcatctgcctgcgcagatccgccggatcaatccccatctttttgctggccatggataaaagcgcgtcggtctgttccggggaaagattaaaattgttgttcaatcaaagtcaccgcctgttttctttcgttccattctatgttatattaatagcagatattcgaaattgtgtgactgcgcacggcggttggccggtgcagatacacgccgggaatgcctcccggattctgacggcgcccgatttttatatgggcggcgggaggtccattttttgatgacacgaatcattgtggtttctgatacgcaccgcgattataaatcgcttgagcgtttggtgttgatgcataaaaaaactgccgatttgtttatccatctgggcgacggcgcgcaggagctggccgctgtgaaaaaaatatatccaaatgtgaaatggttacagacgccgggaaattgcgattatgcaagcggcgaggcgtccgtgggattttatggctgcatgaaggcgcgtattttttatacgcatggtcatatatactgtgtaaaatacgggttggatgcgctcttgactgccggacaggaagttggggcaaatgtgatcctttatgggcatacgcatattccgcatgtcaaatatgaaaatggggtttacctgatgaatcccggaagtctggggcaaccgcgcggcggcggccggacttatggtgtgctcgatgtttcggatagcgagatcgtctgccatatcagcgaactttaactgcaaaaggaacgcagtcacagccgccggacggagaaagaagctgtatgcggcacagcctgtataagcgcggcgcccaaccccactgtttgcggcgcagccgactaaagttttttgccgagctttttttcaaaaaagcgggggcgcagccggctaaagttttttgccgagctttttttcaaaaaagcgggggcacagccgaataaagtattttggcttacctttttttcaaaaaaggtaagaggcttttttgaaaaaatggccggaaaggggagttctgtttgatacgtgcaagcggtatcctgatgcctgttttcagcctgccgtcgccatacgggattgggactgtcgggcaggccgcgtttgattttgtcgatttcctctgcgagtgtggccagacatactggcagatccttcccatcggtccgaccggctatggagacagcccctatcaatcattttctgccttcgcaggcaatccgtatctgatcgaccttgatctgctaattgagcaggagcttttgacgcgcgatgaggctgccgccgactttggggacaacccggatgccgtcgattatggcagactgtataaaaatcgtttcgacgtcctgcggcacgcggcgcgccgtcttggcgatgcaccggagtttgcggccttctgccgcgcgcaggacgcgtggcttgacgaatacgcactgtatatggcgatcaaggctgactgcagcatgaacgcctggtatgcgtggccggaggcgctgcgccgccgcgagccggatgtgctggctgcggcgcgcgcccggctttcggacgacgtacgtttttggaaggcagtgcagtatctctttttcagccagtggcaacgcctcaagacgtatgcaaacgcacacggcgtcctgatcgtcggcgatctgccgatctatgtgtcgcccgactcctccgacctgtgggcgcacggcgagctttttcaaacggacagtgaaggaatgccgacggccgtggccggtgtcccgcccgatgccttttcggccgatgggcagctctggggcaatccgctttacgactggaaacgccacgccgccgacggctatgcctggtggattcgccgcctgcgcgcggccgcaggcgtttatgacgcggtgcgcatcgatcatttccgcggcttcgccggctattacgccattccggcgggatctgaaacggcggctgtcggcgattggaaacctggacccggacttgctttcatcgaaacgatccggcgcgaggtgccggggctttccatcatcgcggaggacctcggctatttgacgcccgaggtgcgccggctgttggctgacagcggttttccgggtatgaaggtgcttcagtttgcttttgacagccgtgaggaaagcgattatctgccgcataattacacgcgcaacagcgttgtttataccggaacacacgacaataccaccacgcgcgactggatcgaaagcgcgccgccggacgacgtggcctttgcgcgtgaatatctgggcgtcggcgaggacgctgattttacgctggcaatggtgcgcgcggcgctttccagcgtctgcgatacggcgatcatccccatggccgactggctgcgcctgggcgcgcagggacgcatcaacacgccgtcgacgctcggcggcaactggatgtggcgcatgcgcgcgggcgaacccggcgcgggactgcgcgccgccatccgccgcctgacaaagatttatggccgtctgccgggaacggctggccggccggacccgcctgcgccttcgcgcgcgagtctcggccgggcggctgtgtccgcctggcgtgcgggctgcggccgtcctgtcgtgccgccgcatccttaaaaaattgtaccaatgggagacgcacacgccctgtctatgtgctttccccgatcggtacagcagcctgaataaaacattgcggacgcgcgccgcggccgcagcgggaggaacgaaatgaaacccttcactgaacagatcgacgaaatcctgcgccttgaaacgggcgcggacgcgtgctccgcttcgccagcggcgctttacagcgccgtctcacgggctgcgatggagcggctgcggccgcagtggaaacgggaaccgggcaaaaagcgcgcctgttatttttccgcggaatttcttgtcgggcggcttgtgcatgcaaatttatttaacctcggcctgctcgatgaatgcaaccgctatctgctggagcgcggcgttgatcccgctgtttttgaacagatcgaggacgacgcgctcggcaacggcgggcttggccggctggccgcgtgctttctcgattcggccgcctcgatgggcgtcccgctcgacggctacggcatccgttaccgctacggattgttccggcagcactttgaaaacggctttcaaatggagacgcccgacaattggctgcgcttcggcgatccgtggagcgtgcggcgcgatgatgagagtgtcctcgtgaccttttccggtcaaacggtgcgcgccgtcccctacgatatgccggcgatcggttatggcggcggcatggtcaacaccctgcgcctgtggcagtcggaggcgcccgacggcgagggatttgatttcgcgctctttaatgaacagaagtacagcgaggctgtacgcctgcgcgacgaagccgaggccatctccgcggtgctctatccgaacgacgacacgccggcgggcaagcgcttgcgcctcaagcagcaatatttcttttcaagcgcgtcgctgcaaagcctgctgcgcgattatacggcgcgccatggcgatgatttttcacattttgccgatgaatatgccatccagctcaacgatacgcatcccgtcgtatcgattccggagctgctgcgcatcctgatgagcgattatctgctttcgtttgacgagtcgttcgcggttgtgcagcgcacgttcgcctacacaaaccacaccattatggccgaggcgcttgaaaaatgggatgtcggcctgttctgctccgtcatcccgcaggtgtatccgtatatcgtcatgcttgacgacgcgcttggccgcgcgctcaaggcgcgcggcatcaccggcgcgggacgcggccggtaccgcatcatcgacggcgagatgatccacatggcgcacatggcgatttttgcctcgcattcggtcaacggcgtagcgaaaatacacacggagattcttaaaaacacggcgctgccggaatggttcgcgctttatcccgaccgcttcaataataagacgaacggcatcacaccgcgccgttggctggcgctttgcaatccggagctgtcgtcgctgattacagagcgtatcggtagcggctggataaccgatctggacgcgctcgaaaagctcgcgccgtatgccggcgatcccactgcgctcgacgcttttttgcgcgtcaagcgtcagaagaaggagcagctctgtgcgtttatcgaggcgcgcgagggcgtcaggttgcgtcccgattttatgtttgacgtgcagattaagcgcctgcacgaatataagcgccagcttctcaatgcgttttccatcctggacttttattttgggattcaggacggccgcatccgggactttacgccgacggtctttctgttcggcgcgaaggcggccccaggctattaccgcgccaaagcgattatcaagtttatcaatgaggtcgcgcggctggtaaacagcgatcctgccatgcgtgaatgtatgaaggtcctgtttgtccagaattacaatgtctcatacgccgagaaactgatccctgccgccgatatttccgaacagatttcgaccgccggcaccgaggccagcggcacgggcaatatgaaatttatgctcaacggcgcggtgacgctcggtacgcttgacggagcgaatatcgaaattgttgagcgcgccggagtggaaaacaactatatctttggcgcgacggtcggggagatcgccgctctggacgggcgctataacccgcgcgccctgtatgaatcggacatgcgcatccggcgtgccgtcgacacgctgatcgacggtacgctcgatgacggccgtaccggcatgttccgcgagctttacagtgccctgcttgacggcgcaagctggcacgcgcccgactgttattttctgctgcacgactttataccgtactgcgatacgcgcctgcgcgccaatcgcgattacgcggaccgcgccgcatttgcgaaaaaatgcctgcttaacgtggcgcacgccgggccgttctcgagcgaccgcaccgtcgccgaatacgcgcgcggcatttggggatgcctttgacgcttgcggacaggatggccgcttcattttgctggtggatgccccgtgggcgcatacgggtttcgcgcagcgcaccgaaaaaagggggagggctttcggcccttcccttttgattccatgcgctgtgctgccagcgcatgaccggcagcggaggatttttccgggagggcaggacagcgctgtgaggaccgcgtaaaggtcatgtaatcgttaaagtttattcataaaaaattcattgttagggaagaactttgtcctgggaatcgattataatgaaggatgtatctttatatatcaaagaggagcggtttgcagacgccgcagggcggcaaaccaaagcgaggggaccggatttatggatcaggagatgaaaaagcagtttgacctctggcatgaggccgatgaatatcaaaaaattgtcgatgccgttttggcgatagatgaaaaagagcgcgattatgaggcggtctcacagctcgcgcgcgcatataacaatctgggccggtatcagaaggcggctgtgcaacttctttctattcaggaggaaggaaagaacgattacctgtggcattaccggatgggatattcctattattatctcgaccgcgcccgcgacgccgcacggtgttttcgtcaggcgctggcgctgcatccgggtgatgaggactgcgccgatatgctgcgccgtgcgatgcgcttgtccgatcggcagaataagagccgcggccgccagacgaaatatctcaaggagaacagccaggctgacgactccgcgccgggccgccgtgaagccgtgcgtttcgcgcccgagctgtacagccgtgaggagcttgaccggcttgaatcgtttattgcccgccgtttcggccgttatgaaagcgtgttccacgagctgatctcgccggatattcatgtcgatattgcgatcatcgcgccggatgagaagcgcaattattacacgctcgtcacaatgggcatgggcgcgcaccggatgaacgtcccggacgagctgcgccgcgaacggctggatcgcgcggagatggtgatttgcctgccgccggactggaaggtgcaggagaaggatgaaaaatggtactggcccatgcgctggctcaaggtgatggcgcgcttgcccggcaatgaaaactcctggctcggctgggggcataccgtgcccaacggcgggccgtttgccgaagggacgcccttcagcgggattctgctcgccacgcctggaccggacgccgacggcggggaggtcgcctgcgagatggacgacggcagccggatctgtttttatcagatggtgccggtttatgaaaatgagatggagtttaaggtggccaatggcgctgatctgctcatcgaacggtttggcgaagcatattccccggtgatggatgtgacgcgccccgactgctgcgctttcatgagccgcaaaaaatgggccaagagcgccgatgagatgaaggagctgctcacaaattgggatggtccggacggctgtattgcgactgaccggatcacagtggacggcagtccggtcggttttatgtaccgcgaggagccaaacagcgatgtcccggacagcggctggcgttttaccgctggagatgaggatgacgaatacatggatgatcccgaaaagtcgggcatttttaccctcaataccatctgtaattatgatccggacatccttccatatctgaatgcgccgtatggaaccgcatatttccgcaatgacgatggtgcgtttgaaatcgatgaggaatggaacccggacggcgatgactatgaatccgatgagccgtcagatgatgggctgtaagcataaacgccctgaaagtgaaaggaggcgcttgtcatggcaatcctgacggaggaaatgcgcgcgcatatcgaaaagctcgacgaggaatgctatctgtatcagattgtggaatacctctacgcaggcgtgcgtgagcggcggtatacacagcgtgcgcttgaaaacgaccttgaagcagtgctctggatcgcatatgtctacatcaatcttgacacatacgaagggtaccggcgcgccgaacaaatcctgcgcaatgtggaaaagcagggcgcaaatagcggcgtgtggtgctatcgctattctgtggcgctgacatatctcggccggtatgagcaggcgcttcaatatgcgcgccagggtacgcggagcgatccggagtatccgtggggatggctccagctttcacgcatcagctatcactgcaagcagcgcgaggaggcgatggccgcggcacggcgcgggctggagcttgtgccgggcgactatgagttcacaacgcagatccgtgaaatcgaggaggatgtgggactctcccgcatggtcagccactatatcgacgaggaggccgaccgtgaacgcaccgatatcgatagcctgacacgcatcgcagccgagcgtgaaaagcgcaacaacaagggaaaaacagaaaagtttgaattttgactgcggcttgtttgaatgccgcggtcagagcggacgttgttccctgtttttcagacaaatcaccgatccccagcgaaccataagcgtccgccggggattttttgcgcccgctgtcatagcgggcgcgctgcttttttaaaaaataacgaaaaaggcttgacatttaaaagcggttgtatataataatatatgaacaatggttcatatgaaagggtgtttgcatggatgctgaaattgaacgctgtgaatttatccacgcgcatgaagaaattgtgaacaaagttaacagtgagatgccggacgatgagatcctctatgatctggccgaactgtttaaaatctttggcgacagcacgcgtattaaaattttgtacgttctgtttgagtccgagatgtgcgtctgcgacattgcgcagctccttaatatgacgcagtcggcgatttcacaccagctgcgtgcactcaagcaaagcaagcttgtcaagtaccgccgcgagggcaaaaccgtattttattcgctggccgacgggcatgtgcgcacgattctcggccaggggatggagcacgttgcggaataaatttttcaatataaaacggtaaagggagtctggaacatgaaaaagcaatttaaactggctgatctcgattgtgccaactgcgctgccaaaatggaggaggcgatcaagcggatcgatggcgtcaatgacgcgtccgtcagcttcatgacgcagaagatgaccgttgacgcggacgacgcgcgctttgaggatatcatgaagcaggtcgtcaagacctgccgaaagatcgaacctgactgcaccattctccagcctttttgaaaaaaggcttcggcaaaaaactttagtcggctgcgcccccgcttttttgaaaaaaagctcggcaaaaaactttagtcggctgcgccgcgaacagtgggacgggcggtacgtttatacaggctgcgccgcgaacagtggggcgggcgctgtctttttcgatctttcagggtgggcgcgtccaagcggacgtgcgcaaattgtggccggatgatttgggaatactgcctttaaaaaggtcaattatttagggggattctaagccatgagcaaaaaacagaaaaaaatgcttgtgcggataggagccggcgccgtactgtttgcgctcgcgctgctgttgccggcggaaggtacgcttcggcttgcggcgtttatcgttccatatgcagttgtcggctgggatgtgctttggcgcgccgtccgaaatatcacacgcggacaggtattcgatgaaaactttttgatggcgcttgcaacggtcggcgcatttgcgaccggcgaatatccggaaggcgtcgccgttatgctgttctatcaggtaggcgagtggttccagagctatgccgtcgggcgctcgcgtcagtcgattgcgtcgctgatggatatccgcccggactatgccaatatcgaacgcgacggcaagctccagcgcgttgatcccgacagtgtggctgtcggcgatgtgattgtcgtgaaagcgggcgaaaaaatcccgcttgacggcgttgtgctcgagggcgcgtccgctgtcgatacggcggcgctgacaggcgaatcgctcccgcgcgacgtacagcccggcgacgacgtcgtcagcggatgcatcaataaaagcggcctgctgcgtgtgcgggtaacaaagatctttggcgaatcaaccgtcgcaaaaatcctggaccttgtcgaaaattcgagcagcaaaaaagcccgtgccgaaaacttcattacacggtttgcgcgttattacaccccggccgtcgtgatcgcggctgcgctgctggccgtcgtgccgccgttggcgcttggttatgcgtggaacgaatggattcaccgcgcgctgattttcttggtcatctcgtgcccgtgcgcgcttgtgatctcggtgccgctcagctttttcggcgggatcggcggcgcgtcgaaacgtggcgtgcttgtcaagggaagcaactaccttgaggtgctggccgatgcggaaatcgttgtgttcgataagaccggtacgctgacaaagggcgttttcaatgtaacggcggttcatcccgacagggtaagtgaagcacgtctgctggaacttgctgcgctggcggagagctattccgaccatccgatttcgcgctctctgcgcgaggcgtatggcaaggagcttgaaacagcgcgcgtatctgatgttgaagaactgtccggccgcggcgtgcgtgccgaaatcgacggacataccgtctgtgcaggcaatgacaaactgatgaaggaggccggcgtgccgtggcatccgtgccaccgcatcggtacgaccgtgcatgtgtcgctcgatggggaatatgtcggccacattgtgatttcggacgaactgaaaccggatgcggcagaagcgattgcagagctgaaacggcgcggtgtgcgcaagactgtgatgctcaccggcgacgcgaaggctgtcggcgaaagcgttgccaaagagcttggtatcgacgaggtgcatgcacagcttttaccgggcgataaggtggaccgtgtcgaggcgcttttgaaggaaaaatcgccgcgtggaaagctggcgtttgtgggcgatggcatcaacgatgcgccggtactttcacgggctgatatcggcattgcaatgggcgcgtttgggtctgatgcggcgattgaggcggctgatattgtgttgatggacgacaagccttcaaaaattgccgtagccatgagcatcgcgaaaaaaacgctgcgcattgtgcatcagaatatcgtgttcgcgcttggcgtcaaagcacttgtactgctgcttggcgcggccggtatggcaaacatgtgggaggccgtgttcgcggatgtgggcgtttcgttcatagcgatcctcaatgcgtcccgtgcgttgaaaaccgacaaattgtgaataatagaaaacaacaggggcgtttcccgctcaaagcgggaaacgcccctgttgttttccaatgccgccggttgtatcaggtctgccggttccggttaagatcacgcagcagagctgtaacatgggcaagctcgtcgccgggcagccgtcgcagttcggcgatggcctcgcgcaggaggactggcgcatcgagcgcgtcgttaaaaaattcggcgggtgtaacgcccagaaattcacaaatagcaaaaaaactggacatggatggcagggcctttcggttttcaatacggttgatatagccgggactttggcctagggaaaggctcatgtcgcgcgcggatacctttttctgcgtgcgcagcttacaaagcctgtccgaaaattcagtttcccacacaaaagaacctctcataattataatttaaagtcattataatcgataaatttatattgttatttcatttaatgtgatgaaatgcttgaaatatatattttaatgtgatattatgtagtcaatatctcattttatgcgatacacgcagatgggatacaaatcttacaacccgcataaagcggggaaattagaaaggagaggtagccaatgaaaagagcactatccctggtgctcgcggtggtcatggtgttcagcctggcgttgggagtggtcgcggcggataccgcgcgcgcagctctggccgattcgggtacggattctggacctgtggactcgggcgcggtgtataccatcacgttcactctgaactatgggacagcgcctgtttcaaagaccgccgagacggacgccgagggaaaggtcacgtgcccgtttacagaggacgagctggtgcgcgccggttatacgttcgacggctggtatgatcgccaatatgaccaaggcggtcagaaggtcgatctgaatacgaaggtattcgagagcagcgttactctgtatgcgcactggaatgaaattgaggttccagacggcatgaacaaggaggatatctccatcgagggcgctcccgagggcgcgaccctgaccatcaccgatcagggacttaccaacacggagacgagcgtcagggaggaaatcgcaaagcttccgaatgtcgaaatcgtgccggaatcgccggttgtcatttacgacatcagccttgaccagtccggcggcaatgtgaccattacgctgccggtgccgaaggggttggacgcctccaaaacgatcatggccctgcactttgccaaggacggcgccgaggcgctcccggtcaagatcgtggacggcaagatgcagttcaccgttgacagcttcagcgaatttgcgttcttcaacgccgacgaagcggttacgtccgacaaggatgtcagagtcacggtcaacacctcgaaaaacggcgtgcttgacatcacaaccgtgggcgacaccggtatggaaggtcccacaaagatcctgcctgtgggtgaaacaaccatcctgccgtataccgatccgacgacgttgcgcgtcagggggggctatacgggcgttgcgtatttgacgattgattacatcgctgctgacggctatacgattgatacggtcacaatgaccggcacaggcagcgatgggcaggcgatcaacgaaacattcgatctgagtgatcatatcggtgataattattatccgaatccgggagacgaactcacgtttacagcgaccttcaaggaggatacgagctacaatcagtatacggaagaatattatgtagcggcttctccatcggactatccggttaagaccggcgagtacgcgcccggcgagatcagctccgagttagagttctggtattggaacgaaacgaccggtgaggatcgccagttgacgccggccacgtttgaactcgacccggacagcacctatcttgataacgctaagttcgaaatcagggacgggaagcttgtcaacaaggttgcactgcccggaacagaggaaacctattccgttcagctcaaggtcacatataacgggacggtctatacaactaaaaatgagggcagcacgcgcatcgataccgatgcatacatctatatcatgggcgatcgcgctaacgtctcctttgaacgtgtagccgccgaaaatctgtcgaccaggttcgattatgtcacaggaaaaaagggcgatacgttcaagagctttgcggatcagattgatcgggaaattccgcagatgcacaacggcgtcctgtctgatggaacagttgtgatacatgaaccgctctactggtacacgactatggatggcgcggagaaatgggcggacggcactgtgattgaccattccgaaatcgcgtatctgcgattcagcaactacaatgtcgacgccggtattgagggcggcgaggacccgggtccaacccccgaccccgatcctgatcccgaccccgatccgcagcccccggttgttaatcctggcggcggctcctccggcggtggcggcagcagtggcggcggttcgcgcctgaataacaagggcggcgcggccacgaccccggtcaaaggcggcggcaatgtcatcaaggcggccgatctgacgagtaaggttaagaagaatgtcggcggcgtagtgacgtccgtcaaaggccagggcggcacgtccggcacggcctacacggtctattccaacgtcccgtccatctcgcccgatctgctgaaaaccgccaatgacgcggctgtgcaggctgcttcgggcagcggtgtgactgtcaagtcgatcctctgcttcgacactgtgcgcagcggccagattatcggacgcatgtatctgaatccggcactgaatacgcttacaaccgatatcaagaccggtatcaccgtcggtaacgcgtcggttgaggccctgttcaccaagtggttccagaataacatcgttgtcatcgacctggcacaccagggttcgttcgggatgccggtagaggtggccgtcaaggcggacctgtcgacgctcaacacaaataccctgcgcttctacaattatgacgcttcgaccaacgtttatacgctgatcgaaaattcgcagtatttcatcgatacaaatgggtatctgcactttgccacggcagtcggcggcccggttattgtgaccgacgcgccgctcgcgctgcggtaattctgctacgccaaaacactctctcttttgcaggcgccccggcggcctcctacaaggctgccggggcgcctgctttttcgttgcgggcaaacgaaaagtgtgatatcatatgcgcagagcaattgcgttgcttgctgctgtcagatgacggcagcttctgcggagcagcggacgcgcatgggcgccgcagccaaaaccggcaaagccggttttgccgccgcttggcggcgggcaggcctaaagggggcctgctgctgcggcgctcgggcgtaggacgaaccgtccgggggattggaggagcacaaccatgtttttttgggatgaggacggcgtgcgctggtatcaggcggctgccgcgtacagcgattttcacgcgcggctggcgcagatgattgcaatgggcctgacgccggacgatacgctgtgcgatcttggctgtggggtcggctgcctgtcgcttgcgcttgccccctatgtgcgcgaggtgacggccgtcgatatcgatgcacgggcgctggcagcgctgcgcgcgcaggcggctgtccacaatgcgccgcccatacggatcatacaggcggcttttcccgacctgccgccggacagcctgtgggatgctgtcgtctgttgtttttttggccgcttgaccgatgaggggatgcttgaccgcctgctgtcgctctgccgcagacaactgatcgttgttgtcaatacaggacagaaaagtaatattgcgccgtccggacgttcacaccatcaaaaggaatgctccaacgaggtcgccgcgcttttaaaagagcgcggattagcgttccgattcatgacagcggcgcttgaatttggacagccggctgactccctggaggatgcggcggcttttatccgccattattcgcccggctgtagcgcgccgcaggcgctcaatcatgcacgcaggcaggcaatgcttctgccggacggccggtattatctgccgaacggaaaacagttcaccgtgttttttatcgaagcgcgtggtgcatgacggtttgagggaacaggctccccggttacttataaaaaccccggcccgcctatggcgagccggggttttatagattatcccgcggctattttacggttcttttgcattgcaaaatgactaagcgcgtaaagctttatgctttctttttcatacgctcaaacgctgtgagatcatgccccttgagcgctgcctccaaaagctgcggcaaaagctgcggcgtgcaggcaaagcaggggatgccaagcgcgctgacacgctgcgccatatgcgcgctgtaatacgggctgccgctgtccgacacggccagcaggctgattactgtgacgccggaagctttcatatcctccagacggcgcagcagactggcctggttgccgccttcgtccagatcgctgatcaggaaaaaaagcgttttggccggctgttcgatgaattgctggcaataggcgaccgaacggttgatatcggtgccgccgccgagctggatgccatagagcagatcgaccgggtcgtcgcttttttcagtcagatcggtgatggacgtatcaaaggccacgatacgcgttttgatcgcgttcatgctggcgaggatacacgccatgatcgaagaaaagatcacggactcgcccatggaaccgctttgatcgatgtcaaggatgaccgtccagttgtttgtacggttggagcggtcaaagaaaaagaaacgttccggaagaatggtttttaaatcgggattataatttttcaggtttcgttcaatcgtcagcttataatcgagcgcggctgcggaaggcagcggcgaatgcgcgcgccggttgagcgccgccgttacagcgcggcggatatcgttttccagcatgcggttgatttcttccacgatttttttgatgaatgcgcgcacgctttcttttgaccttttcgggatctggtcgcgcagcgtcatcagcgtggaggccagcccgatatcgggctccagattttgcagcagctccggttcaaataaaagctgccgcagcccgcgccgctcgatggcgtcgctttggatcacggtgacgatttcgcggtcgaacagggcgcgcacatcgccgagccacttggaaatacgcgggcttgacgggccgctgcccgcgccgcgtccgccgagcgcgtcggctccggcgtcgccgccatagatggcgccgagcgcctgatccatcaaaagctgttcctcggtcagcccgcacgcgcccatgcgctccaggcgctcttgcgcctgcgctcccaagatcagccgccagcgcgcgaggcgctgtgcgggatcaattgcagtattcatggcaagcacctcacagatcgtcaaaatcgaattcatccagcgcgtccaaagcagcctgctccggctctgttaaagcagcgccgagcgcctcgccggcgctgcgtgcgtcgacgccccacacttcgccaagattttctgcgatttcatttttctccttgggagagaaatcggcaaaggcgcgccgcagaaaaacgagcgcgcgcttgaattccgtctcgtcaagcgtatcgatatatgcgccgagctgctcccaaaggctcagacgggcgatcagggcataacggttcttcatggaaagcccctcgaaccagcccgcgcccagctccgcggggacgcccggcgaaaggcggcggcacacttcggcggaaagcagctcgttcgtgattttaccgcgctccagaaggatcgccgtcgcaaagccggaaagctttgtattcaggtcgtcgcggtcggacaggtcggtcaggacagagagccagcgcgcctcgtcgacacagtcggcatggttaagcgcaacggtgttgagcgcaccaatcgcatcggcaagcaggccggccgcgctattgtcgcaggcgcagcttcccggtaggatgagacacgcgcgcagaaagagctggcttaaaattggaaggagcggcgcggggtcgagccggcggatgctgccgaacctgacagccgccgaaagactttcggcggtggccgcgatttccggcacagcggccgcgtcgacggccaacccttgcagggttccggtggccagcgcgatggttcgcggcataccgcacaaaaacgcgtcctccaaaatagacgcggtcccgctgatggactgggccgcttccagccgctccttgaaggcgaaggcagccgccagctcgattgtctcgccgcgcagggccgattcgacaagctctatctcggcttcgggcgtccattgcagcgtccagttttccgcccaggtggcgcggtcctgccgggaggcggctaccgtgccgaaccggacgccgagcacgcgcaggcggtgcaggaaaaacgaccggttcaaatcgagaaaggttgattgctccgacttgacgcgcgtgttttcacgcaggtccaattcaagcggctgcgcggtcaacgccttgtatttttcgagctttaattcccgcaggcaacggtaaaaatcggcttggatcgaggtgcggctcacaccgtcgggcaggctgccgatgcaggagccgatctccgtgtcggccgccgcctgtgcgatttcggaaaaatggccgtgtcccatgcaggcgacggccgcgtcgcgcagatcctgcaggacgggaagggctggaccgcgcatcccggcgagcgcgccggccaggcggactgcctcaatcacctcggcggaggaggtgattgcgccgtgcgcgcgcatatatgcggccatccgcgtcaaatacgcgtagcctgccgcgcctggctcgccgccccggcggatcgcgtcccaaagcagctcgtaataggcgggggcgcggttgcccgcgccgtaacccgacagcgacgacagccggtagtaggagtagggcatcagcgtgctttgcgcaggcagcgacggcagcgcggctgtttcactgtcggagagcggtgcgcagcgttcaagcccggcaacatggtatgcgccggtgacgacgacgatccggtcatcgtcaaagccctctgcaagcgcctcattgatgcggcgcttcatatacgcctcgcgcacgtcgttttcggccgtttcatagcgggtgtgcgccgcagtctcccgaagctggcggccgtaagccgccgcgcccaacagatacgcgccgtccgagaggttatgctcaaaccgccgctcccagtacgcctcctggtccggctcgctggccaggcgcgcgagcgcgtcgtaaacagcgccggtcgaccgcccgtccgggagctgctcacggtcatccgccccgtcattcccggcgccggattcctccatgcgcttcgcgcgcgcgtcagccatcgctaaaaacgtcccggacggcaggtcgatgaaccggcaggccttttggttgcggtgcgcccacagaatcgcctgatattccggcgaatagacggcgaacgggtaaaggatgctgcgcacaggaaccgtttcactgtaagccataatggcgacgggcggcttcacgccgtcgagacaaagctgcgggatcagcgtcgaaagatcgcccggcccttcaatcagcaccagctcggggcggatctcgtcgagcaggcgcagcagatggtgcgcgccgcccggcgacaggtggcgcacgccgaacaggatgggcattatgcgttcagctccttgcaggcctgatagagcgcgcgcagctttgcgccgcgctttttcatgacgttttcaagatattccttccaggcgacggcgtccttctcctcatccttgacgacggcgccctgaagcgcggcggcaaggtcgccgtcccggatgacgccgtcgccgaagctggccgcgagcgccatgccgtttgccaaaagcgaaattgcttcggcggtggagagcacgccgcaggttgtcttaagcttttgcgatttatcaagcgtcacgccgccgcgcagctcgcggaagatcgtgacgacattttcgacaagctctgcgcccggggcctgcgcgcgcaggccaagcgaaccggaaagctgctccacgcgcgtgcgcacaatttcgatttccgtttcgatatcggccggcgcgggaagcacgacaatattaaagcggcgtttgagcgcggctgacatctcattgacgcccttgtcgcgcgtgttggccgtggcgatgacggaaaatccctttttagcgggcagctcgaacgcaagctccggcacggagacgcgcttttccgacagaatggagatcagcgcgtcctgcacctcggaggcgcaacgtgagatttcctccatgcgggcgatagtacccgtctccatcgcgcggtaaatcgggcttttaatcatcgcctcgcgcgagggtccctgtgcaatcagcatcgcatagttccaggaataacggatttgttcctcagttgtgcctgcggtaccctggacgaccttggtcgaatcgccgttgacagcggcgcacagatgctccgacagccatgatttggcggtgccaggttcaccgatcagcagcaaggcgcggtcggtgacaagcgttgcaatcgcaatttccaccaggcggcggttgcccatatatttcggcgtgatcgccacgcccttggcggtgccgccagtaatataggtaagcaccgaacgcggcgacatgcgccagccggcgggaacagggtcctgttcggcggcgatcagcgcgtcaagctcggtctgataaagctcctctgcggggagacgctggaattctgtattggccatgcgtgggttcgtcctttctgttttttggcatctgcatacggcagagattattcaccggcgcgcccattcctcctgaaggcgcgtcagctcggcctgctttgtctgctccggcatggggaattcgtcgtacagggatgcggcaatataccgcccgatccggcgagattccgcggcgccgagggatttgagcgtcttggggatcaggccgctgaaatcctgctgcccgcagtggcgcaggtcatagagcgtttcaaagcccacgccgcttttcccaacccggccgagcagatagggccttagcagcgcacagctttcagcatcatgcggattgacaatgcgggaaaaccagcttggagccgtataaccgtggtcggtaagcggctggccgagcgcctgccgccagtggccgtattttaaaatcatgcgcagccagcggatgccgagcgaatcagtgaaggtgcgccggctgatttcaaccgccatgccggtgcgtcccgttttgctgttataatagagcgtccgcatcacccacagcagcggctccgactggccggggtcgccaaagaacggctcaaagccgtcataagccgcctcggtatcagtcagaagcgccgccgcaaaaccggcgatccggtatggctcgccgcagcggctgtaaagcgcctgcacagggccgaccgccgccgggttatccagcatcgtctgtatcaggcggaagttgacggccatcagcggtgtgaatcgggcgggcggcagattggggataccggaaatgctgaacatgccgcgtataatccggtccatgctttcgtcactgatgtatccgccgcgcatggccggcgacgcgccgagctgttcgagcgcagcgaacagcttgggcgaggtcttatgtacgatggcgcgcaacagattgtgcacatacgcttcgcgctcctgcgggcatggctgcgagtccgcggcgtccgcctcatcggccaaccggacgagcaggtccgcgaccgcgtccgaaacaagatccgaatccgtcccatagactagcttgagggtatcggccgatacgcctgcggctgtcaggcggtcaagccagaaggcgtcgacctggccgccgcgcatctgggaaagcgcctcaagcgccgcggagcggacgccgcccttggctttgccaacgtattcaatcagaagcgggatgttggccgggtcgtggcgcagcgcgcgcacagcggcctcctggataacggtcgagccttcctcggccagacgcaggtaaagcgcgttttcacgcgctccggctgccgcctgaatgatgtcgatgcggcggaccatgtcctttttcttgcttgccgggtccagcccgcgcttgagcagcggcacggcctgcggcatggtggaaagaatccgcgcggccaggtcggcgatctcgctgtagctgtcgccgagcgcgccggcgagtgcttccatcagacgaaagtcgcgcagcgcgggacggttctcatcaagggccgtgcgcaggatttcatagcggccgctgccgcgcgttgtcagggcggtgtaaagcgccgacagctcgctgtatcgcgcgcctgaatcgatgccgggacagccggcggccatcggttccagctcgccctgcacgccgcagcctgcctgcgtcagcacgacggcgtcgacaagcgtgatcgcgtcgagtagcacggacgccttgtcagcgcaggcgggatcggccagcggcgcggcagtctgatagatgcgcgcgagcacaggcgaggaagcctgtgcctgcgcgagctgctcgagcgcccgcgccaggcggaaatcctcgccgatgacgtttagaccggcaatggcgcacgcgtgcaggcgctcctgcaattcattcaaaagaggcaaagccatttcatatacactccttcctcaaaagctcaaccgcacaatccggtcgccgctgacgatggaaagtggctcaagcaggatgcgtccgcgtttggcatcgtaaaaaaacctgccggccagcacctgattttccagcagattggcgtccggcaaatagtccagacaggcggtggcagacggagaaccgcgcccgcacagctcgactgtagcgccggtacggtcgcgcagcgcacagatgccctgcgtctggccgatctgctcataggcaatcagacagacggccgtcttttctgacagcgcgtttttaatctggtttttgacctccttgaccgcgacggccagattggtccgggctgccgcgcggatggctgcgcagtcggccggcgtaagcggccgcgaagtaaacgattcccaacgcacgcgccggttcaattcgcccggataaagatacaggcgtgggatttgcaggcatcccagcacggtatcatcctgtttgatatgcttgactgccttgagcggccgcagattctcctttttatagacggcgccggtcgaaagctcgacccaatagcccgtatctatgtattcggcgcgcgccgcatcaaattcaattgtgaaggagagctgcgccagcaccgcattgtcgcggtaaaggccaagctcgtcaagctgcgaaagctgccagatatagccgatgcggtcgtacagcatggaatcctccatgctgacggcgccgccttcgacctttccctgcaaaaaagcgcgcgcttttttaatggtggcgtgcaattggacaaggatttcgatggtccgccggcggctgtcctcctcgcgcgcgggatcgtcctgcagcgcctccagctccagcaggatggcgttgatgagcgcctgcgggccgggcaggtaatagtcgcccatctgctttgccagcgagcggtaggtctgtatggaaccgcccgaaagcgctgccaggccgccggttatcacatcgctcacaaagcggtcggcaagcgaaagaccctcgagctgcttttgcatctttttggccagcgtggccgtatttgtttttttcgtcgcggccttggcgtccgtaccggcggccttggccgctttgcgctgctcaagtttcccgcgctttgcgaggatgtcctctgggatatcgcacggcgcgaatgtccggccgccgagcgcctccatcaagagggcgagcgcgtgcttgcagggaatctgacggctcgggcagctgcagcggagcaccggcgccgccggatcgataaaatcggccgaggtatggtatggattttttccgctgcccttgcagtcgccgcataaatacgtgccgtcctccgatttgccgagattgataaaatcgccgcgcgccgcgatttttttggcgttgccgagcgcggccgcgttcggcgcgagcgtgtggatcagctcctccgtgatctgcatgtcagaaccccccatatagaaattaaaaagaatcgtgcaatcgcccgaggacagaatcggttaaacgcggggcaggacacaaaaccccactcgggcgctgctttcaggcggaggcaatggccgccgcctgaaaaaaagccggccgcattccacagaatgggccggcgcccgctttttttaaatacgggtgtttcatccagatgaattttataatgccagcagagcgtccttcttttcgaggatttgcgcgacaattgcgcaggcgggacagtcgcagtaccgcgcgccggccgccttgatctgctctgcatgctcaacgatttgagcggccttttccgcgccgaaataggccgcgccggcctcggagcctgcaaagccgatcaagttgtcaatcggcatgatatccgcttccagctcctcaatatacgctttagtctgtgctttttgcgcgcctgtccctacggcgtccagccatttctgcgcggcctcttttgtttcgccgctgcaagtcggagcatccatcagctcgcgcgtttttgcaacaatctgatccaatacgttctgatccatgaaccattcgccaactttcttttcattctttttgcgccgccctggcggtgcgccgaacaggccgccatgttatgattttaccatatcaaggcagcgggtacaaggccatgccgcgcaaaaataggaaaagacactggcctggtgctggggatatttttgtcagcttaatgcaacagccgaaaaagatcgttttataaatccccaaaacagggtgttttctttttcgatcttttttgctataatctgtataggtggagaatttaataagcgggatgatcagatggataatctttgttttgtaatcatgccctttggggatctctttgatgaactctacaagaaggtttatgcaccggcaatcgaggcgatgggcctggaacctttgcgggcggatgagatttataataaccggccgattatagatgacatcaaccaatccatttatcatgcagcaatcgtgctggcagatgtcaccggaagaaacccaaatgtcaactatgaattgggcattgcccatgcgctgaaaaaagaggtcgtcattttgactgcctcaccggacgacgttccctccgattacaggcatataagatatatcggatacgaccgcacgggcattgattggaaccgaaaattatccaaggatattcaaaaaactttacagcaggtccttctccggctgaaggatctgaacgatgcacagtatgaatcgttcgaatcagacgacacaaacgaatggaacagcgaggaaaaagagacgattgccagggcgatgaatttagggatgaaatttcaaccggacccgcgctccctgtctcacgctttgatgcgctgtatgggctgttatgtcatgctggaccgccgggacggccctgtgaccgaatggggcgccgcggtggcctgcctgttaaatgaaaaggtccatatgctgataaacgaacagcaaaaaggccactgcctgcggatgcgtagtgtttttttcgatatatatgcctcgcacgcattttatgttgattatctttacgattcgaaagttctccccatgtatacgcggcaggaactgtggcgctatttaagagacgagttctgcgggcaatgctttgagcctcatattcgctatgtacaggaaaattttgaccatgaccgatttaatgtggatcaggatcaatactattccttaggcagtctgccccaggaacgaaatccgatctgttgcagggacaatttttatgtggccgatatctcagacgtgtatttcaacgaggcaagaggcgagcattattaccgtattgacgggcttttgcctccctcgcttttgggtgcgcaaccgattccagatgaaaaccattggctggcggattgggggcagaagcagcagcggttccagataggggatactgtaaaatttaaggtaaaaaaagtgtatgaacccaaaaaatatgaccacatagataaggccagaaatattactttttcacagatagagatcgtatccagggcctgaaaccgatgcattccattgtaaaacaataaccgcgggacggctataatactgggtgatgcccaacgatttgccgcttaggcggcccacaccttttgacgggcaattttaccataccgctgcgcggacatggtatcacatgcgcggatgcaaacggcaaagccgtttgcgtccgccatccggcggcaaccgctgccaaggcagcggaccgcgcatgtcgttgcgccgcagccgaaaccggcaaagccggtttcgctgccgcaaagcggcaggcaagccctctcgggcttgccgctgtgacatcatataaaaaatagatacccttaacggtatggagatgatttatatgagacaatgtatggatgccgaaaacctgcaccgccgcttgaaaaaaattatcgggcaggttcaggctattgaccggatggtggacgaggatgtcccctgcgaggatgttctggctcagatcaacgccgcaaaatccgcccttcacggctgtggaaaggtagtgctggagggtcacatcaagcactgtgtccgggatggtcttgaacatggagatgcggacaaaaccatcgagagttttaccaaagccgtagagcggttttccaacatggggtgacagaatataagcaaagcagttcatttgaactgctttttctttttatcctcttgacaacatatacccccatgggtattatatacctataccctgtatggtaatgaaaagaggatcattatgaaagcactcatggagaagctggaacatctgttggagctgggaggcatcaaaaaggatataacgctgctggttatctccggcattgctgtcatatgcagtctggcgaatgtgcagccgtttccctttgatatcgcatgggccgccatcattctttgcggcgtccctattattttggaggctgtcatcggactggtcacggcctttgatatcaaggcggatgtactggtttctctggctctgatcgcctcgatctgtataggtgaaacctttgctgcgggcgaggtggcctttattatgcagttaggcgctctgctggaggagctgacagtggcaaaagccagggcggggattgaaaagctggtgcatctcacgccccagacagcgcgagtactgcacaatgggaaggaaacggttattccagcgcaggaggtcagggtaggagatctgcttcgggtgcttcccggcgagagcgttccggtagacggagtgattacctttgggcagacctccatcaatcaggcggtcatgaccggtgaatccctgccagtggacaagagcgtgggcgacgaggtatccagcggcacgctgaatctgtttggcgcctttgaattaaaggctacgaaggtaggagaggacagttccatccagaggatgatccggctggtacaatcggccgacgcgggtaaggcgaaaattgtgggcattgctgaccgctgggctacctggatcgtagttatcgccctttcggcagcggcactgacctggttgttcaccgggcagattatccgggctgtcaccattttggttgtgttctgtccctgcgccctggtgctggcgacacccaccgctgtcatggcagctatcggcaacgctgccaggcatggttttctcgtccgggaaggcgatgctctggaacggctggccagagtgaagctggtcgcgtttgataagactggtaccctgacctatggtacgcccaaggtagtagcggctaagagcctgtcggacctatataccgacagagaactataccgcttggcagcctctgccgaagttctctccgagcatccattgggaaaagccattgtggactgctacaaaaaatcgagcggtccagctatttctcccgccgatggctttcagatgattcctggacgtggtgtgtttgtaacagtagacggaaaaaagatcctggcgggcaacacagagctgcttcatgaacggggaatcgattttatgtccccagtggaggcggacgcttatgtggagcagggctgtaccgtcacctatctggcggtggacggtcagtttgccggatatatcgcgctctcggatacattgcggggggaaagtgaaaatagcatcgtcaagctctttgcgctaaaggtccagcctgttctgctgactggcgatcatgagaacgcggcaaatgctattgcggcgcaacttcacattcggcaggttcgtgccaactgtctgccgcaggataagctggattatatcgacaaagtccagcgttccggagagccggtctgtatgatcggcgacggcatcaacgacgcgcctgcactgaaaatggcggaggtaggcatcgctatgggcggtgtaggcagcgatatcgccgtggatgcggcggatatcgcgctggtggacgacgaggtgaaggaacttcctcatctgatcgccttgtctaagcggatgatgaccaccattaagctgaatatgaccttctcaatggcactgaactttctggccattgtgctggcgatcttcggggcactgaatcctgtggttggtgcactggtacataatgccggctctgtcttggtcatcatgaactcggcgcttttgctcaagtggaaaaaagagtgaaaacatttaaagaggatggaatccattgtgggagagcattgagatgatgcagatccatagcggtaatactatataaaaacaaaattgcaaagcccgtacagatgaaccgtttccagtttgccgtgcagataagcccaacctccccccaaaatgatacatcaactatgagcagctattttcacacaaaaaaacggctgctcttttttgtgccgtcaggcagaaaggagcggttacccaggcagatcggaaaaaatatgtgcggatttttaagactttctttgacgcatggctgcccgcattggataataaaagatcgttcggtatggcatcaaccataaagagaggaaagcgatgaccatttgtatgggaaaagcgaaccgcaaaagagcgcatctggagatgaaaacgctcttgaagtccgctaaaagccgcaaacgcactgtgcggcaggtttttgcagcaatcggtcgaacccactatacgtagggtgcgggcgcttttttttggaaataaaaaagcctggagcgcgagttggctccagaccattgcttagtggcgcgcctgaggggattcgaacctccgacctaccgcttaggaggcggtcgctctatcctgctgagctacaggcgcaaagataccgttttattatagctaagatgggacatcttgtcaaccgcgcaatataagagacgccgcattcggtatacagtgcgggtcgctttttatcggttaaattgctgatttcacttttaaaacagatacaaacgtgatatattaataagtatctgtacagcccgcgctgcgcgcggcgcatgtgaaaaccggggcgcgggtccgcgcttgacttgaaaggactgaaacgatcgtgatacgcgagaaatcctgcggtgcgcttgtttaccgcaaaaagcaggaccggctggagctgctgctgatccggcataaaaacggcggccattggtcatttccaaagggacatgtggagacgggcgagactgagccgcaaactgcgctgcgtgaaatcaaagaggagacggggcttgacgttgggctgtgcgagggatttcggcagagcgtggaatattttccaaagccgcatgttaaaaagcaggttgtctatttccttgcgtcgcctgacggagacgatacggtgcgccggcaggaggaggagatcagtgaatataaatggtgcttgcttgacgaggccgatacgatggttacttttaaaaatgataaacacctgatcaatgaagcacgccgttatctgtccggacggagtccagccgtccgcacagagaggtaatttatatttttaaaaagaaaggcgctgtaaactgcttggaacagagacaaaaccacagaagccgcttgttttcatcgcctacgcgtgtgattgccctgagctttgcggcagtcattttaatcggtacgctcttgctgatgctgccggcgtccagccgcgcgggacagcctacgccgtttttggactgcctgttcacggcaacctccgctacatgtgtgacggggttagttgtgtatgatacctatcagcattggacgccgcttggacaggtgattatcctgctgctgattcagatcggcgggcttgggcttgtcacgctgacacaatttttcaatgtaatgatcgggcgcaagcttggactgcgcgggatgcatttggcgcaggaatcggtcgcctcctcggaacccgatgtataccgtatgctgcgtcttgttatcagaacgtccgccgttgtcgaaggagctggcgccattattctgatgtttgtgttcatacccgaatttggagcggagggcgtgtttgtcgcagtgtttacggcggtgtccgcgttctgcaacgcaggctttgatttgtttggccgtaaaacggcttttctgtcgctgtgcggttatgccgccaacccagttgtcattgcggttgtcggttttctgatcattatcggcggtattggtttcatcgtcgtctatgacctgtcgcaataccgccatacaaagcagcttacgctgcatacgcgcgttgtactgacagctacagcaattctgctttttgcaggaactctgtttacagctgcttttgaatggtcgaatccagcaacgctcgggccgatgccgcccatgcaaaaaatcggagcggcatggtttcattctgtaagctgccgcaccgccggcttcaatgtattttccattgaaggaatgaacggtgtgacaaaaattctgtcgtctgttctcatgttttttggcgcggctcccggctcaacaggcggcggcatcaagatcacctctgtggcagttatttttatgatggtttacagtgtgattcgcggcgacgaggatactctgatttttggccggcgggtggaaaagagcgccgtctataaatcattcgctgtgatgattctgggggtactggctgttacgattacagcgggcgcgattgttgcaaccatgcgtgagacgcacgctgtggcaggcgttgacgccttgcttgaaagcgtttccgcctttgcgaccgtcggattgtccgcgggcatttccgctcaggcgaacgctttgtgcttattgcttcttatcttttccatgtatatcgggcgtctcggtccggtatcctttttcctgtccctggcggcgcgctccacgcataagcgccggctgattgtgccggaggggaaaattcagattggatgagttgtgctttgcgtgcatccgtttcccatatgggcaagcaggctcttaaaaagccgccgcccacgtgtccgccctaaaaatcaggagggcggcgcgggcggcggccttttttgcggcggccttcagcgcatcattgtttcaacactatccagcacgctgccaagcgtacggatcgctttcgcagtgttctgcttgagctttttgccgggtgttgccttgcgatgactcagcatataagctgcggtgcctgccaaagcggccattgccacgccggtgactgcggtcgtcgtcgatttgttcattgataccacctccgtttattttacgcgcccatgcccagggcgttgggaatgcgcgggacgcgccggcgtcccctgatgaacagtatgcccggattcaggcggctctattgcaaaaaatacagataaacagaagtttgcatcgctggcgctttttggattatatggatttggttaaaagaagcgaaaagcaggctggaaagccggtataaacgcggctattggcccgctgttcgcggcgcagcctatataaatatcagagcctgatccacgattcgcggcgcagccgactaaagttttttgccgaggcttttttttcaaaaaagccggaaagttttttgcaaagttttttaaaaaaagcgggaaggagagagaaggatggagaaaagaccgccgcgtgtcgcggcaatccatgggctggccggattcgggcgcagctctctggcagttgttattccaacgctttcgtcaatgggcgctcaggtatgtcctgtaccgacggctgtgctgtcaacgcacaccggcgggctgggcgatgtggaatatcgcgatctgaccgattatatccggccgtgtctggagcattatcagcgtttggagcttggctttgaggcggtgtattccggattcctgtcaagtcccgcgcaagcagacgacgttgaagcgtttatcgcagcgtatcccgatgcgctggctgtcgtcgatccggttatgggcgatcatggaaggccataccgaacctgtacaccggaactgatggcgcgtatgcgcgcacttgtcagatcggccgatgtgattacgccaaatccgacggaggcgtccgttttgctcggcgagccataccgctttgagccgcagacacggcagacgctcaaaagtatgcttgcgcggctttcggaattaagcccgcaatacgttgtgatcacaggcgttgaaacgatgcagggaggctatgtgaacgtaggctatgaccgcgcgcgcaatgcctattggcgggtgccttacgattatgtgcccacgtcctatcccggaacaggcgatatttttgcaagcgtactgaccggcgggatgatgaacggcgacagtttcccgatcgccatggagcgcgcgacgcgctttattgaattggccattaaaacgaccttcagctatggaacagacacacggtatggcgtcatgttggaaaaatgtttgccatggttatcgcagaatgtcgtattaaaaggatatgaaattttgtgaaaaataacagtttggctcgcctttactagatttttactgacgcagcttttcagattcgtcaatatgatacaatatgcgcgaggcaaacggttttgctgcttgcagctaccgttcggcggcaaccgctgcaaagcagcggactgcgcatgttgcatcacagccaaaaccggccttgttgctgtggtgcaacaggataaattatcatttgaggaggatcccagaaatgaacacttatcaaccgcatcgctccagcctcggcgggctggatgccaatatcatggcattgctttgttatcttgtgacatttgtcggcggattgataccggtcgtcaaatatgttgcatggcttctgccgcttgtgatcgtattcctggaaaaggaaagcggcctcgtcaaattccatgcgatgcaggcgtttgtactgaacctgatctcgtttgtagtgacggtgctcatcactatcctgacggtagtcggcgccggggcggctgttgtcgcaggatcggctgtcgcgaccgtcggcgtgcttagtgtacttgggatcgtctctcttgtggtcggcatcgcgattctggtattcagcatcattgccatggtcaaatcgtatggttatcaagcgtacaacataccggtgatcggcggtattgcacaggcgcttgtcagcaaatttccgccggcgaatatccagagctgattaaaaataataaagaaaaagcagcggcagccctgcgttttgcggggttgccgctgctttttcacgcagctcacattgtttgtggagcaatcggctaaaattttttttgcgctttttattttatataaaacgcgtacagaccgcaggggccggccgctcgatcgagcggccggcccctgcggcgatatgggatagaagaagtaatgacaaatcagaggaacaactgtgtgtccaccaccgttttggcaacgacgcggccgtcacggataacatagagacgctccggattcaaacggatggcgtcgcgcgcgtcgtcggcattgacgatcacaaggttggcgcggcagccctcctcaattccgtagccgtcgagcttgaggatgcggttggcgtcatatgtaatcatatcatagaccttttcaatttcatccggcaggctcatctgtgcagcatgcgccaccacgttggcgacctggagcatatcgccgctgccataggggtaaaatgtgtctttgacacaatcctgcccgtaggagacgttgacgccggccgcaagcagctccttgacgcgtgtgatgccgcggcggatcggctgcttgtcgccgcgtccctggagcatcagattggtgacggggtttgtgatgatatgaacgccggcttttttaaccttgtcaatcacataggatgcataatgatcgtcgtaggcagccaacgcacaggtatggcctgctgtcacacggttttgccagccgcgcgcaagcgtttcatccgcgaccatctcaagcgtgcggtaaaaaggatcgtctgtttcatcaacatgcatatcaatctcagcgttgtacttttcggcaatgtcaaaacagagctttacatgcgcaaggctgtcggcagggcagttttcattggcgggcataccacccacaacgtcggctccggcctccatagcctcccacatcagcttgtcacagccaggatccttgacaataccctcttgaggaaaggccacgatctgaatgtcgatgacgttcttatatttttcacgcagcgcaagaacgccttcaagcggacgcaggccaccgattgtatcaacgtcaacgtgcgtgcgaatggcgagcgttccgtttttaatcgcctttttaactacgtcctcgccgcgcgcgacaatatcgccgatggtgtagatgcgcttttggtcccacaggatttcaatcgcttctttgagcgtgccgcttttgtttggccggacaacatcaaatacgttgaccttatcgagatggatatgtggatcgatcagagacggtgtggtcaattttccgcgcgcgtcgatgatctcgccctgcacgccttcaatttttggcgcgatgcgcttaatacggccattttcaatttgaatatcaactgtgccgtcgcggcctcgcagccttgcgttttgaatcaacagttgcatatcattccctcctgttaataccttgttataagtttgggtacgccgcagcatgattttttagattcgtacttgactttgattcggagatgtgttacattttgttacataaagaataacacaattaattataaaagtaaagatatttttgtaaattttacagcaatatcttttggaatcagtcttgagaacaggatgtttaagtcctgttacatatttgtttcataaaaggaggggttttcatgatcattggaagcagtcacggcgtcggaggcaaggttgaatcagaagtattgagcgttgtctgcgcacaactcgaacctatccatgcggattgcatggaggaggtcaaccgcaacatcgatacaatcatccagtacatggagacaggcgcgcgcgggtttcctggctatgacctgttcgttaccccggaattcgcagtacaggggatgcacccgaccaagcgtctcaatgtcgttttgacactcgattcgcctgaagtcgcccgcctgcgtgaggcctgcgcgcgcctgcgcgtatggggcattttcagcgtgattctcaagctcgatggtcacgacagccccggcaactgcgccatcatgatcaacgatcagggcgaggtcgtacatcggtacgtcaaaatgaacccatggattccgacagagcggcactaccccggatgggaatgcccggtcacgcccggcccaaagggatcgaagattgcgacaatcgtctgcgccgatggcgattatcccgagatttggcgcgaagccgcttataacggtgcaaatattatcgtgcggccgacccactacatgagtccctgggaaaacggttgggatattacaaacaaaatgggcgcctactgcaaccagtgctatgttgtcgcagtcaattgtgtcggtgtggaggcggcatgctctgcatttggaatgagcatgattgttgcgccagacggcaacgtcattacaaaggcgccggccggcgtcccctatattgtcaaggcggatctgtatcctggcttggttgacaagcttcatgagagcagcgtgaccaatacgtttttgtattcgttccggcaccgcggtgcgtcgtgccatgatttgggcggtcacggcgaaacgcgctgccaatacaatgcctatacttatgggggtgaacagaatgagtatgatgcgtgaaattccatacctgctggcaacgcattatattgtgatcgccatgcgtccgatcacatttcccgcaaccaaggcgcagatcattgaaagggtgggggacgagatgatccccacatcgcccgacggctgcacgccgctgcgtgagctggtggaaaaaatcccgctggaacgttttggatgcgcggcggaattttactgtgcgttcaatgcaagctgagatcagttttttgaggagggaatgattatgcaggataaccaaaacagccgcgtgggggaagcgcgtttcgtatcgccaagcgatctgtccgtcaattttacaaaaaaacagatggtatttttggggcttcaaaacactgtggctatgagcggcgtcatcattgtgccgatactctgcgggctaaacgtttctgtgacattgttttgcgcgggcatcggaaccctgatttatcagtttattgacaaagggattgttccggcgtttctgggcggttcattcgccttcatcgcgccgctgaccatgatcattacggatatgggcatcccctatgcgcagggcggccttgttttcgtcatgtgtttttattttctgtttgccctgctgctcaagctgctcggaacagaacgtataaacagggtatttccgccggtgatcaccggtccgattatcattgtgcttggcctcagcctggcgtcggtcggcgtatcctcagcttcggccaactggcctgtcgcgctgctcacctttggcatcgcggtcgttgtcaatatctttggaaaagggcttactaaaatcctgaccatcgtgctcgcgcttgtcggcggttatctgatctcaatcccgtttggactcgtcgacttttccggcgtcatggaggctgcctggtttggcgtcccaagctttacgctgccgaaatttgatgtgcgcgccatcatcgcaatcgcacccgcggcaatcgttccgtgtattgaacatatcggcgatgttatcgcagtcggcacgacagtaggtaaggattttactaaaaatccgggcctgccgcgctctctgttcgcatgcggctgcgccacctgtgtttctgcgtgtctgggcggtccgtcgctcaccattcacagtgaaaatacaggcgtgcttgcggtcacacgcatttattcgccgtttgtcgtccgctgcggcgctgtctggatggcgttgttcgcatttatcccgaaatttgaggcgctctgccgctccattcccgatccggtacttggcggtgtaggcatcctgctgtatggtatggttgcgaatgtgggcgtccgtacagttgttgaaaaccatgtcgacttctccaaagccaagaacctgattgtctccagcgcaattttgatccttgcggtcggcggcgcaacgttcaactttcccggcggcatcagcatcggcggactcgctgtcgctgcgatcgcaggcattatcctgaacctaatcctccccgataagcaggtcgaataatttcccgcttttttgaaaaaagcttggcaaaaaacttttcggcctttttttaaaaaggcctcggcgaaaaactttagtcggctatgccgcgaacagtggggcgggtgctgtgcgtatacaggctgcgcctgccccggggttgggtccatgggacaggggcggcccggcccctgtcccgtgaggtgcgaaaaggggcgctgccgcggcttgttcgcgcccggcggcttgtagccgccggaaagccccgaatagccggccgggcaagcgcagcgtccggcggtgagcgacccgcgcacgggtcgcgcgcgcccccgccccttctaaacttttaaataaaggccgcccggcattgccttgtggaatgtcgggcggccttcatatcagaacgtttccaggtgaaacagtccctgcgggcaccgctggacacacagcccgcagccggtacactgcgaggagttcagatgcacgccgtcaggctccataacaagcgcgccgtacatgcagccgcacgtacacagcccgcagccggtacggctgcaaggctgcgtcatccggcagacggcgcggcggtgcacagccttttcaaacggggtaagcgacgacaaagcggccccagtgatagagctgtaatcgtcgtatccatgtgcctgcatccagtcctccagcgcgcgcacggttttggtaatcagatcataaccgtgcagcatgatagccgaaccgagctgcgcggcggcggcgccgagcatgataaattcaaggatgctgcggtaatcctcaacgccgccaacaccgcagatgggcaggtcggtcagttgtgcaagcgtcgcggtcgcagccagggaaatgggccggatgtggcggcccgtatagccgccgtaggtcggcataagggttgtttgcgtctcgagatcgacgccggaaagcgcacgcaggctttcaatcgcacagatagcgcgcagtcccgcacgctccacagcgtgcagatggggcgcgctggcggccagattgtacggcagacgcgtcatgaccggaatggagactgcgctggccgcggcgtgcacaaactcataaagcttttccggctgaaggtggatgtcctcgatcattgaatccataggcgcgtaaaggtcaagctgaagcgcgtcggcgccgagacgctctgtcctttgggcgatataggcgatctccgacgggcttgaggcacgaatgctgcaaatcagatggcagctgtctttgcggacgcgttcaacctcgccttcccactcctcaagggtgcgcttgccatacagcgaaagattgagcagctcgtcgtcatgatagtagatgcgcggactgaaaagccaaggttcctccataacgatcgtttctgtaatgacagccgccgcgcccgcatcgatgcatttttgaatagctgcagcgccgccggaccatggacctgctgcgacgattagggggtttttaagcgccagccccataaaggatatgggttttgtcatcaacgtgccctcctttccagaatacactttactcaaacaatgtattgatgtgcctccggttgccgcaggaagcgcggattttcagctttggcagcaaaacgatttcctgcggtgtggtgtccgcggccggaattccgtcgatcatgtcaaacagcatacgtgccgccaccattcccagacggtgcgtcggctgctcaacggtggtcagctccggcgtaacgatgccggcggttggggagtcggtaaagcctgtgacggcgatttcatccggaacgccgaccccatgctcaagcagcgccttcataaagccgaaggccagttcgtcgctggctgcgaaaatcgcatcgggcaagctgccggcgaggacctcgagcgccgcttcataacccgcgtgcacgccgttttccgacgcgcgcaggacacggccgccgtcaggttcaagaccggctgcgcgttgcgcccgcagcagcccctcctgcatactggccgcgacattgggccggtgctcgtttgtcaaaagccacaggcgttttctgccaagctccagaagatggcgcgccatgcgataggcgccttcctcgaaattgacgtagcaggcgttaaaatgcgcggccgcagggcagcgttccgcaagaacaaatggcatatgcgcgtttacaaggcgcgccgcgctttccgcaccgagcgaggaggagcagataatcaggccgtcgaaccgctgcccgattgccgcgcgcagcagttcgtcctccgggcggccgcccgtgccgcacaggtaaacggaacaatcccgccgtgcggccacactttccaccccaaagagcaggcgttgtataagataatcgccggcgtgctcggccagcaggcagatagagccggtccgcgcggcggctccgcgtgcggcggggttgtaattgtgggcgcgcatcaccgaaagaacatgtgcgcgcgtttccggctggacgacctccgggcggttgatcacacgtgacaccgtcgcaatggaaacattcgcaagctttgcaatctccctgacattcatgtgccgcaccgcctttcataagtttggagtttgtggaactgcaagtgtgtttatccaatcggagacagtgtgacgctttcggcgattgcctgtacctgcgcgcggtccaggatgtccggcacaaatgcaatcccgatataaacgcgcaaccgcttgtcgtaagaaagcacgccataggtttccagatgggggacgtccggcatcgcgccagggtgcttgtctatttcattgggatcgagataccagatttccgccacgccggtttccgccgtatcggtggctttgaccgccgtatatggatcccagtggaaaaaggaagaaaggcgcaggccggggtaaaccgccttataatactccgcctgcgggatatcgccgtcgaaaggttcaaaaacattaaagccgatatagccaatgggttcgtccccgcttgaaatggagagcggcgtataaaaatcaccggggatggggaccacatccttgggcggcgtttggccgactgtccagcctgcggggagcgccagctccacctgaaactttgcggcggaattgattcgctcgacagcgggaagctgcgcagggttgggttcggtatatgcggggaattcaatggagacagtctgcacctgcggcgctgtggacgtgtcagtttctccggtgccgctttgcacaggcgccggagaggcgctgctgtgcgtatgtatggaaacgccgccgcatgccgcgccggcaacggtcagcgtaagaaggaacagaaccgacagaaagcgtttcacaagctgtttgcctcctttttcgtttggccaaagcggggaaagatccatccgaatgctgcaaattccccatcctgattgtagcaggatttttatcgaaaaaccagccccttttacaaggacaacggcgctttgtctatagcgggagggcagagaatgcccctgccaaaaagctgttttggcaggggcatttttttgtcagttgcatttcgaatatccgcagctgcggcagctcacacagccgccctcatgctcgagcgcgcttccgcattcagggcagaacttcgaaccgtgctcggtcgtttctggcgcttccgccgcacaggatgcgcacggcgcattcggcgcggcaacaggcaggccctgctggagcgcgatcatgtcggccgtctttttgatgacgcgcgcgatcgcgtccgggcaggaggtgcacttcatacccgcgtgacgaatggtcgaaggacagcggatgccgcggagctggtcgaggatttcgtcgatagacacgccggaacgcagcgcaatcgacgcgagccgcgccgtcgcctccgactgcgacgggcagccgcccgccttgccggtcgaggtgaatacctcgcagataccctgctcgtcgtagttgaccgtcacatagaggttgccgcagccgattttcatgcgttccgtcagcccgcaggtgacctccggacgcgggcgcggcttgatttgaccaaaaccggctggctgttcggctttggcaggggcgccgccctcctttttgacggaaccgatgttgagcacctggctgtcgcggctgccgtcgcggtagatcgtgacgcccttgcagccaagctcataggaaagcatatagacttcgcgcacgtcttcaatggtggcgtcgtgcttaaagttgacggtcttggacacagcgttgtcggtgaactgctggaacgcggcctgcatcttggtgtgataaagcgggcttacgtcgtgcgagcagacaaatacacggcggatgtcggccggaatttcctcgatatgctgcagcgagccttcggcggcgatctttttcatcagcccgtcgctgtacaggccgcgcgcctccaggatctccttgaggacagggttgacttcgatcatttcggtgccgtccataacgttgcggataaagacataggcgaataccggttcgacacccgaggagcagccggcgatgatggaaagcgtgccggtcggcgcaatcgtggtgacggtcgcgttgcgaagcggcgttccgcccgcatagatactcttttcaaacagtggaaacgcgccgcgcactttggcaagctcggctgattctgcgcggccggttttggtgatgaactccataacgcggcgggcgagcgcgacggcctcgtcggaattgtaaggtacgcccagataagcgagcatatcggaccagcccatcacgccaagcccgattttacgggtctgtttggttgtaacgtcaatttccgcgagcggatatttgttgacgtcgatcacattgtcgagaaaatgcactgcgtcgcgcacggtgcggccgagcttgtcataatcgacggcgtatgcgccgttttcacatttgagcatattgacaaggttgatcgagccgaggttgcacgactcatacggaagcaagggctgctcgccgcagggattggtgctttcgatctcgccctgcgaaggcacgacgttgtcgcggttgagccgatccagaaaaataatgccgggttcgccgttgcgccatgcgctttccacaattttgtcaaagacctcgcgcgcgtcgagctggccgactgcctgctttgttttgggatcgacaagttcataagcattgccctgctggaccgcctgcataaattcctcggtgatgccgaccgagatgttaaaattggtgatgtcggcgttatttttcttgcagtcgataaactccaggatatcgggatgatcgatgcgcaggatgcccatgtttgcgccgcgccgcgtgcctccctgcttgactgcctcggtggccatattgaacacgcgcataaagctgaccggaccgctggccacgccgcccgtactgcgcacggtcgcgccggctgcgcgcaggcgcgagaaggaaaagcccgtcccgccgcccgatttgtggattaaggccgcctgcttgatggcttcgaagatttcctccatcgaatcgcccaccggcagcacaaaacaggcggaaagctggccaagctccttgccggcgttcatcaaggtcggggagttcggcaaaaactccagatttgtcatcatctcataaaatcggtttgacagtgccgcaacgtcagtcttgccgctgtaagcggcgtcggccgaagcgattgcatcagcaacgcgccggaacatctgctcgactgtttcaatattttccccgtgttcatcctttttcagataacgccgctccaaaacggtcagcgcgtttttgccaattttcatcatttgatcccccaacatgatctggtattccttgcactatgcgaacgctatatattgtagcatgttccaggaagggatgcaatggcctcacagaaaaaatctccagagcgcgccggtacgcttctaaccgcacggaaaagatggccccatatgcgcatatagataaagcaggaggtgagcaaatggggaaaggacgcctgacggtcattgcggcggcgcttgcagtggcctgcgcgattgcccgcgggattccagcggatccggcgcgcgaacagactgcggtcggcttgcggcagggctatttgaccggcgcgcgcgtttatcaaacggacgggccgcttgatccgcaggcggcagtacaggcttacctggaagggcagtatgaatcgtatttgacgatggagccgctcgatctgtcggcggtggcggacgcagagagccgcgcggtcaaaaacgaactgctctggctgcggctgctgatccagcgaaggcggcttttgatgaacagccatctttgttatgtgccagtcagggcgctgccatacacgattgtatggattgatgaaagcgagttgaaggatccgcggatggaggcgctcggcacgcccggagagggggagatggaccttcattttataataacaggcgaagccgggcaggcatatccgccaatgctggcggtaaatgcgcagcatacggtgcgcctgcgccgggacagcggcggctggaaggtgacgctgcacgagtatccgggcgcttcgcggcggttcggagaggctgtgcctgctgtgccgtcgaaccggacggcgatggaacgcctgcgcatggaattcgcacgtctggcggcggatacggcgccgggggcgccggcgggcgcggcgctgtatgatgggaaagcagcggcggcctatgccgcccgatggatgcagccgcccaatcccgcgtattacgatatcggcgactggatcggaaactgtgccaatttcacctctcaatgtatccgcgccggctttggcggcggcgacagcccgcagggcggcgcggcgatgacggacgagtggtttgccggggcggggggcggttcgcccgcatgggaaaatgtcgggaagttctgggactatgcgatgcgcgccggcgattttggcgcgatgattgtaccaactgcggcgtctctgcgtgtcggcgatctggtgcaggtgcggtccggcagcggcggcttcaatcacaatctgcttgtggttgatgcgcgcacgctgcgccttgcacaaaattcgcccgactgccttgtgtattacgctgatctcgtcaataccagtatgcgggcgctgcgcccctgctggctcgcctgagcgttcgcatgtttgcgggccgcgccgcatggcgcggcccgcaaacagccaagggcgtgccgcacaagcggcgcgcccttggccccaagccgccgggaccggctctatgccggccccggcggtctgttttgcacataatcagcgataggaggcttcgaagatcgcgcgcacgtcatcgtcggaaagcggcgcgggatcgactgcataaagcccgcccatggtggcgcgcgcgttttggacatactgctccagatgttcgcgctgtacgccgtaggcgctcatacggatatcgtcgacgccgcacgctttttgcagcgcagccagcgcgtcgacaaaatcggacggtttggaagcgtctgttttcccaagggcgcgcgccatgcgcaccaggcgttcgtcacagcagccgcttttcgcccaatggctgtaataggcgcagctcacggaaataagcgccgcaccgtgttcaaactgcggatggaaggcgctgagcgcatgtgcaaagctgtgctcggaggtgcatccagaggttgactccaccataccggctagcgtgttggccaacgccacgtcggcgcgcgcatccagattggagccgtctttgacagccgtttccaggcttttgccgatcaaacggatcgcttcaagcgcgtaaagatcgctcatcacataggcggtgttgttgagatagccctccgtgctgtgaaacagcgcgtcaaagccctgataggcggtcagacgcggcggaaccgtggccatcagttcgggatcgacaaccgcgagaacggggaatgtcttgtcgtagccgccgccgatcttttcatttgtctctgtttttgtgataacggtccatggatcggcctcggtacccgtcccggccgtcgttgtgatcgcaacgacaggcaagggatcgttcggtacgggcaggcccttgccgctgccgccgtttatataatcccagtagtcgccgctgttggcggccatgatggcaatggccttggcggaatcgattgcgctgccgccccccagcccgacgacaaaatcacagcccgatgcttttgcgagcgcggcgccctccatgacatgttccttaactgggttcggcaggattttgtcaaataaaatatggctgacgcccgcgcggtcaagctcctgcccgacacgttcaagataaccgaattttttgactgactgccccccggttgttacaatcagggcctttttgcccgggagctgctgtgtgtgcagggcatttaactgccctttgccaaagaggatacgcgttggaatataatactgaaacttcatatgaccgctcctttttctgaatttatccgccaaaagcggttgtctgacaaagaaaatacagatataggacaataaaggaaatcaagccatctggcaataattgtatcatattttacatttaatcacaagcgcgcttatgaaaattgtcctatatcgagccatgcttcataataatcgtacagcgcgccctcctcatgcgctgaaacaataaaccgtccatacaaggggccaaccggataccccattgcttgtgcggccgcagtaaaatcagccgcgctgttttgtgccggatcatccgataggacgcgcagcagtccataccaatagttgcgcggcacgtcgtcccgccgttttagcgcgtccgggcgcgggctggtttccgaagggcagaagattccataggacggcgcgccgccttgcgggattacgatacctgattcgtgcacatcgtaaacatatgtttgtacgctggcctcatcctcaaaagaaaatggacggattgccggaagctggtcgcttatcagtgtaatcgcacttgtgcgcagatgatccaggcgtgctattgcgccgcgcatcgcacggatatgttcgatagcgttttcaagctcgtgaatctgtgcggaaagcttttgttcattttctacgagcagggcgtcgagacggctggcgtccatatccggcagcgatcgtatatcgcgcagggggatggacagccgccggaacagcagaacattggagatgtccagcattgtctgaacacagggacggcggtaattgttttgctcatcacgctcaaaccggacaagcccgatgcggtcccaatagcgaagcgccgacggtgcgacgccaaacagccgcgccacagcagcgatacaatcgtcttttttcatcatagacctccaagatagcggcattttttgaaaacagcggcatagcagatgtttttggtgcacattgcctgctttgcggacaggcgcatgattatcaaatgctcctaagccatcggctgacctgttttttagaagaacaggtcagccgatgactcctgaataaaacggcgaatgagagtatgcgggtttttatggatcagctacgtcatcggcgtccaactgttcccattttccatgcaatattttaaaaaatgcctgataggtcatctttttcggaacaattttatagtgaaaaacactgctgtctgatgcaggcgcaatgagaatcagttttgactgaggataaaacgtcagcctgtgcgtatccgtgcatagttcactgctctgctcgctcgacatagctttttcaagctgttccataaaagccctgttatattttgccttgagtatgaaatcaaaggttcttatcatatatccaccttctgtcattgagcattcacaaatttgaaagatacgattgaccggatgccggccgaggggcttgacatttaagtaactttaaggtttatactatctttattctaacagaaaacagggagtttgttatggtcaagcaattttttaaacaagtgctgcccgcgatggctgctttcgcattttcgggactttatacgatcgtggacggcttttttatcggccgcagtgttggcgacgtagggttggccgctgtcaatatcgcctatccgctgtctgcgctgcttcaggcggccggtacaggcattggtatgggagcggcagtctgtatttccgtttgccgtggccgcggcgatacacgcggcgaacgcggacatctgggaggggcgtttttgctgctggcggctgccggcgttctgcttgcggtgagtcttttttcattcggcacgccggcgctcgctgctcttggcgcgcgcggtgaagtgctcgaacaggcgatcgtttatctccgtgtgattttgctgggtataccgtttcagcttgccgctaccgcgcttgcgccgctgattcgaaattacgatggcgcgcttgcagctatgggcgcaatgatcgctgggtttgtcacaaatatcgtactcgatgcgctgtttgtttctgtattcgggtgggggatggccggcgcggccggagccacggtcattggacagattgtcacggcggttccatgcgctttttatctgtggcgcgtgaccttccggattggaagcggtccggtcaggccggccggacatatgtgcggctcgattctgcgcacagccgtttctccgtttgggcttgcaatgtcgccgctctttgtaattatgcttcttaataaggcggcatctgtttatggtggagaatcatccgtagctgcgtatgccgtaatttcttatgcaacggctgtcgttatgcttctgttgcaaggggtgggtgatggaagccaaccgcagatgagcctgtattttggcatggaccggccggaacggacaaaggcggtgcgtaatcttgcgtatgctttcgcagcggtgacggctgttgccaatatcgttgcactctgtcttttgcgcgcggcgattcctgtgtttttcggcgcctcaggcgaagcggctgcgatggccgccaaggcgatgcctgtctttacaatcggttttatcccgattgcgttttgccgtgtaacaaccgcatatttttatgcgacgcagcacaaccggcccgcatatgtgatggtttatggagaggcggttttgcttgcgttgctgctggcttttgtgttgccgcgcatgatcgggatggatggcgtgtggatttctctgccggtcgcacagattttgctgatgctgattggctgcggtctgctatggcggtcgcgccgaaaccgggtaaaggattccgggaaggtttcgaatgaaacggtatgcgatacccctgcgctttaaaagtatgggggagggggcggcgcggccggtcctgcgcacgcatgtgcgcaggacagacaaacgccgcctggcgtttgtctgaggcctgcctgcggcgcaggcaggcccccggccgcgccccttgcccccaaggcgctgaaagggccggttccaactggaaccggccctttcagcgccttggggcgcttcacacatccgcggtcatataataagcgcccgcccgtgcaaccgtaaattcaagcacgatcccttcgtcctcgttttttacacgcgtctccagcggcgcgcccgtatcatcatatatttgaacgcctttctttccaagcagagactgcggaagcaccgcgcggatcaaaataggagcctgcggcacagcggcggcgccgtccgcgcctgtaaaagcgatagaataagcgtacagcgtctgtttggaaacattgggcagggactgactgcgtggcgcgccggtcacggaaaatcggacgctgccctgcgggaacgcgccaagcatgccgacggcacgtacagggcgctccccggcggacgcctgccagccgaggctgtatgcatcatattgccatccgcagagcgtttgcagtcgctcgatcacctgagcatccacctgcgcgcgcagtgcggcgggcatggcgtaatattcaatcagggctacttccgcgtctgcgccggcagcagtggaaacccttgttaaatacatgcaaagttcatcggagattgtaaaggcgacgcgccgggccggactgtgattgcctgcggcgtcgcgcacacaaacatcaaacgcgtagctgccgggatttgtaaacgatactgtgtacacgccgtccgtcggttctatgtattgccatccatcgttttcacgaatgcagacaagctccaaatcatagaacgtcgcagggcgtacttcaacatccaccttgcccgaaaatatattggtattcggcgcctttgctccggtcaaaacgactgtgggcgtatctggtgcgagcacgtcgatagccggctgcatattgctcaaccagccgacaagttttgtcaggcgatgctgttctgagatagggaacagtgcgcgctgactttcagtcaaatcgctccagcgcgactgtacgtccataattttttcacgctgcgcctccacctcgctgtcggtcgccgtgaaaaggttcgggagcgcgcgactgtcgtcgatcagctgcgcaagcacaggatcgattgtaaagctttccgcacgaggttcgccgcgcgtgccgtccggcgcctgagtacaaaaacgaagcttatattcccgcggctggcgaaaggtgagcgtataattttgctccttatccggcgtcagctccatccagacgccgccgtcctcgatgagcaaggtgtcctgcggatgctccggcaagagcgtaagcgttacagacgaacggtatacatagctgccatcgaccaaatcgcctgtttgatcgatatccagaccaccgggtgtttgagcggccaggacggacatgggcaatgcccacagggtacagacggccgccaccagagcggccggtcgctttagatgcataattagattcacctgcaaactttgttggagtatttattaaaagggtactatatccgcaagaggaaatcaaccgtttcagagaaagtttccgtgccaaaatcaggctgtagccgggcgctgattcagacgcctcagagaaaagccgtacggcgcgcatggtgaggtccatgcgcgccgtacggcttattatgtttgaaacagtgctatcaggagttgccctgcactgtgggctgcgccgttttaccgcttcggacataggtctggaagataaagagagccagacatgcgagcgcgaaaacaatacccacaggataggcgatggaggtggcgagccggaagccttcaggagcctgaaggatataggtcatgctgaccgcggacatgaaagcggcgggcagcgcggccataaagcagcacaccggcgggaagccgaacttatgaagaaatacagcgcctgtccaaagaactaccattgcgagcgtctgattggaccaggagaagtagcgccacagaatatcaaagggaagggcgacggcggtgaatgcgccgattgccaacagggggatggaaagagcggcgcggtaggaagtcttggactggtcgatgcggaaccagtcggcaatggtcagacggcaggaacgaaacgccgtgtcgcctgatgtgatcggacaggcgatgacgccgatcatagcgagcacgccgccgaccggacccatcagggtggtggaaatattgtaaacaaccgtgccctgcccaagggcgctgatggcttctgagagcgggccgacgccattgtagaaggtgacgcccgcgcaggcccagatcagagcgatgatgccttcagcaaccatcgcgccgtaaaagaccttgcggccttccttttcggaagtcatgcagcgcgccatcatcggagactgggtggcatgaaagccggagatcgcgccgcaggcgacggtgacaaacatcatggcccattttggcaggccggtggggtgaacgaccgcaagcgaattccatagctcgggcatctggctggaatatgccgggttcagaaggagagtccccgcgatgccggcggccatgatgatcaggcaaattccaaagatcggataaatcttgccgataattttatcgattggcaggaaggtagccagcaggtaataaatcatgataacagccagccagaacgatgtgttcaggacctcgggagtcagcatgccgatgagcgcggccggaccgaccgagaagttgatgccgaccaacaaaagcaagacaacggaaaaaacacgcataataaaagaaatgaccttgcccatgtatgtgccgacaatttccgagatagaagcgccgtcatggcgttcggacatcatgcctgaaaggaaatcgtgcacgccgccgcctaggatggtgccaaacacaatccacaggtagacctgcggaccccagcaggcgccggccaaggcgccatagataggcccaagccccgcgatattcaaaagctgaatcaggaaaatacgccaagttttcatcggaacataatcgacaccgtcgggatgcgcaagagccggcgtctgccggtcgtcaatatggaatacgcgctccaccagttttccataggtaaagaaaccgacaatcagtaaagccaggcaaacaaaaaatgtaatcattcgccgtaaaccctcctcacttattcctctggaaaattttctacttgaccggtctgttttattctaaattatggatgttcgttcgtcaagcggctacgcaaaaaaatatatatcaacgatctattttgtagagatgaacaaatggtgaacaaacaatttgtatataaaaaccagcgcccgcattcacagcaatagaacagggtaaaaagaggagcgcgcatgaatttctcaatccacacgcgctgcaatgtcagctttgttttacaaggaagataaattttccttagacatttttgagcgatgccggaatccttaatcatggattttccccgaacgatgcgagctatgctggcaacagtaataaatggttactcgggccaatccaccttggacaactcgtctaaaaaatgcgcccccaattcaggctctaccattttgacatagtatgcttttccataaagatgctcccgataatgtatagagcgtgccgcctttgtgttttccaaatgggcagtgactccgaacttttggcaatagtggatttcctgccgcaatttgcgcttaaaagtcttgggcacgctgacacgattatgtacagtcaggccggtaatgcgttttggctgtccaggattgtatactctgcatttatcaagattcatcaaaaagccatgtttgcccaagatcaaccccagcgcgtccagaagctggggctgctgctgatttgtggagatcgcgatatcatccgcataacgagtgaatatgccacggaagcgccgcgccattgcgccaagctcatcatcgagatcgcggcagatcatattcgaaagatatggactggtgggagcgccctgagggagtacgccatcgtaacagcataaatcacacagggtattggcggcggatccgctgtaccccatgttccggaagatcggcaggacctgttttttcgtaatggatggaaaaaagtctgtgatatctacgcagtatgtgtatgcatacccgatatgaaggatggcattcgtcacaatagaccgctcaggcacaaagccatgggtacacggggaagcttcttttcggatcaagatattctgatagatccactgctgacggagcttcagtttgcggctgggagccgtgatgatccggctcccattgtgtttgggaatggtgaacctgtggtagtcgcacaggcggggagcggccatgccaagcacctttcggatatgtgtttggtcaaataggacgggtaatccctgtttgagcaaattttccgcgtaggtacagcactgtgcgatatactcgggtgaaaatcggggattttcagagatctccatcgcatgacgcagccgatttacataatcatttggctccattgcaaacccatcgtttcatcaataatatatctaaaaccgggaacgatcactaaataaattgtaataataatggatctgtctgtttgccgtgcgtgcgtcgcagagaatgaaatgaacaagacgcacgcacggcaaacagtggttagtgccgtttgatcaagggggcgaattcaccccggtctgatcgttcccggttttattctaatgtgaggtttagcggaatataaaggtccgtccaagaaaactctgaagaaatcggggcctcatctattggcgttgagaacgaagtgcagattgtcaaagcccggtcagtcagacgaaaagttccctggcgttccatagaaagaaaccccagcgacatgagcttttggatacgatggtctaccgccattgtatgggcgcccaatgcccgggccgcatcgcgaaacagcatatcgggatgtgcgcgcagataacccaacaactgacgatcaaaataatcaattaggtccattttgcattcgccctttgctcagctttgattttgtatgcattgttgtccttttttcgcttcaccgattgtaagtactttaactgaatttgaggttgcttttcccgaggaaacagcggcgtatgcgtatcagtccagcgccaaaatgtgcataatgtgttattaggggtattatagtaaaatgatacaagctgtctacatccccaaaagcccaatatatatgatttatttggctccttcatatatgcatcaatcaaaacttcgtatttgcggatccgcgctatagcgtcggctcgctcagaaatcgcgaagatatccgtgcgctggaacgcagggacggcgatccactcctgattataaatcaggttaatattgacgcctctttttttcaactgtccgataagataggagagacccgcgtccgtcggaacaatacaaagcacaaaaagcgggagattaataaaatccggaaattgattcaaaaaagataaaattgtccgaagcagggtgaagccagtgccaacaatatcatccacaaagacaaaaccgcgatagtcgtccagttcatctgcagacagcttacgcgtgcaagcgacgatctggcgggcgtctatttgtcccatacataaacggtgcaaatctgtgcgaacatgatcactccccgctttccacttgtctgatgattctgttgtaataaataacaaatcacaaagggagaggcccaaggattgcagcgtgtccgtcaggatatggataccctcatgataccgccggacagaagcctcgttggtcagataagtatatcggctcaacaggcgcaaaaataactcccggtcagatggatcgacaatggccagccactggtctactttttcggagagatactcgagcttcggatcgagatatctggaaatttgcgccggatcgatttgattatattgaaaaaattccgcaatagcctgttcctttgtcacgaaaacctcccagaggattggtcaaaataatgaactcttgataaaattatatataaaaattgtaaactggtcaaggtaaaagagaagctgcactttagcctcttttcaaaggctaaagtgcagcttccagattggtacgcccgatgcgattcgaacgcacggcctttagagtcggagtctaacgctctatccagctgagctacgggcgcataagctacagcaattctcaatgattaaaagctgatgcctatatagtatagcataatttgtacggattgcaatcaattttgtgaattttttcttttttgtatgggaatgatagagatgcaggcgaagaacggaaaattgttttcaacatgaaattgttgaaattgttggaaactggcttggaaaggcgtgtttgaatgttgaaaacatgttgaaaaattatgtaggtaaatttttttaattttttttgtaaaaaccgcttgactttgccggaaattcatgatagactgaaactcccgcttgagggtgacgcccacaggccggggacaagcagcaccttgaaaaatgaacaacgagaaggaaagaaccgaagtgaaaccggaagggcttgagaaagtccggaaggggataataaccgctttgcggttattataccatgtccgcgaagcggcatggtataattgcccatcaaaaggcggttgccgtgcaagcggcgagccgttgggcatagcccggtataataaccgctctacggttattataccatatataatacctcaatccgccataataatcaaatattttataggccggtcataaaatatttacagtctgcctgtacatatctgtaaacgattctccccatctgtcagattcaaattcgatgcacccatttcatgtgcccaacatagtataaaacaaattcatcaatttgcgaggtgtcaacaaaatgtgttataacaatggttgcggcatgcagaactactgcggtaatggctgctacaacaacggctgcggcggctttggcggttatggctacggctcctggctctggattatcctcatcattatcatcatctttggtttcggctgctgctgacagccggacacacccaaagcggcggccccggattaaccggggccgccgtttttgtttaccgcaggtcaggccgaataatccacatcatactcccgtgcgacctcaagcgaggctggctctccatctatgtaattgacacggacagaataactgcttccatggaaatagctggaggagccatcctcacggtcctctgcgtcaggcacatgttccttcagtacggcgggagttaaatctggcagcgccaccccgtcaaagctgacgccctcgagcggattgtcaagctccgaatcaatcttgacggacgcaatcacagcatcttgcacggggacgctctccttttcagtcacgagagccaatgtaacgcgcttgacagcatccttcatcatatagacgccggtataataagaatttgcatccatcggctgcgacgggctgatatccgccgcgccaatcatccccggcgccacgcttttcatcgtaaaaccggcgtcaaacaggacgcccgccttcgtttcgccgacaatgatctccgtaccgtcgatcgcaaccggatacgccttgtcgcttttactggagcacgcagacaatgcgaggcacaaagccgccagcattgccagaacaccgcccaatcccaatttctttttcataacacaacctccatcatgatcagcggttctgcatccgccgtctatttcccgcaggcacacagcaaagcagccgtgattccgtcacgatcagatcgaccggcacgtcatacctgccatgccaaagacgtgggcgcaggttatgcgcatagatcacgccgatttttggacctgtatattgcgacaggaaccggtcatagtaccctgccccataaccgagacgatagccgcggcggtcataggcaagcgccgggacaatacagatgctgccctcaaagtcctccaaaagcacgcagcgttcacggacaggctcaagcacgccgaaggtctgcgcagcaaggtcctccagagaatgaatcagaaaaaattccatctcccgccggccttccacgcagcgcggcgccgcaacccgcttgccgtctgcaagcgcgcgctcaatcagcgcgatggtatccacctcaatcggcttggaaacgtatgtcagcaccgtgccgcacgacgcgtattcgtgcagccccgtgacacgccgcaaaatccgcgcgtccgcggcctgttttttctccggcgtcattgcgcgcctccaatccttgatctccgcgcgcagccgctgcttgagcggccggatatctacgccctgcattgcagcgccgcccggatctctccggcgcgcgcggcatccgtcaaaacctcgacaagcttgaggccaaaatcgaccgcgacgcccattccgcgcgccgtcacaaaacgcccgtcgacgcagacgtagtcgcccgaaaggcgcgccgcgcccaattgatcctgaaaaccgggattggccgtcgcctccagcccgtccagcaggcctttatgccccaggattgagggcgcggcacagatcgccgccagccacaaaccgttctgcgccgcatagtcgacaaaccgctgcactacaggcgacgcctccagattcggcgtaccgggcacgccgcctggcagcacgaccatctccagaccgtctatgcgcgcctcgtcgtccacaagatcacagacgaccgtaatcccatgcgatccggtgatctttcggccgcccacaccgacagtctgaacctccaggcgagcgcgccgcagcacatcgacggcggcgagcgcctcgatctcctcaaagccttcggccagaaaaacataaatcataaactgcctcctcaaattctgaaatcaaccgctgtttcggccggcggcacgccgttatcccttcttttaatcgagcacaaggctgatgtagggcgcgcgtccgggatgctcaaacacccgctcacgcgctgccgcgtcataccagcaggtcacgcccgccgccacgcgttcaagcggaaaaggacaggccatatccggtggcagggtcagatgatattcatcggcgttgtatttgctttgcagcacggacagtgccgtgcgcacatccatgccgtcgagcgcaagctctttgacgcgcacgctcccgccatcgttgcggcagaccgccacagcccgcgtcccgcccgcttcaagcagaagcgtttcacccccgccaaaggccgtttccgtcaaacgataggcaagcgcgtcgccatcccaccgtacaaacatcgtgcgcccggcaaaagcgcgctcacgcagcagcatgaattcagaggcggtcgcctccgagatggcaaagctcttttcatacggcataatccggtcgcgcgggacaatcgcgcggccgctgtaaaattccgtatcaaagccgcgcttgccatagaaattgtaaagcgccgcgtttgacggcacgagcacagacagcttgacgcccgcctcgcgcatcgccttgtgcgcggccgcaagaagctttgtgctgatgccccggccgcggtatgacggcagcgttgcgacggcgtaaacatagcgcgccggcagaataccggcctgcgtcacaacggtcatcggaagcagcgaaagcatcgaggcgatatggtcgccgtcaaggaacaccatcgtatggcgcgcggcgtcgtgctgttcaaaatacaggtccacatatgcgttgctgtccccaaaacatgcgctccacagttcccttaactgcccgcgcatcccctcgtctgcgaaacggatcatgcgttgtccctccccgcgtcactgttcggtcacaataaatttttcaagcaggatcgccggcttataggaaagcttggcccgccgaagcccttcgtcgcccacatcgtcctcacggttgacatatttgaaatcggcgcagttatgcgccgcaaattccctgttgatcatcggatacgcgccagccacatccgaaaatgccttttcaatatggacgatgaacgtatccgaattgagcggcaggcccatcgtatacgccacaacgcgcccgtccacacgcagaagtccgccgcgaaggccgagcgccaaaaaattttcaaagcagttgcgcacagcgcacagctcctccatcaagctcggatcctctccgcagccgttttgctcgcaccaccgggtattcatactccagcattcggcaatattttcgggcgtgatcgcctcaaacgaccaacccccttcatgttccgcctggaaacggttgataaaattgcgtttgctgtgcagctttttgccggaaagggtaatcagtttttcgctttcataaatgtagtcgaaatgatcccgcgtctcctcaaatgtgaaacgtcccggaaacagtgtctccaacgccgcaacgctctcctttgtcaccccgctcatcacaagcggctcgccgcgcagcgcggcgtcggccgacagcgcatcaatcaccggctttacgtcgccgctgccggacggaaacagatacgaccgcggctgaccgtcccggccggaacgcacaagatagtaatcattcatgcgcgcgacctctatgtgataaagcttgcggtaaataaaattgttggaaaatgtatactcgctgccgcggaaattccccatgcgcagcagcggatcgatccacgccttgtccgacaattcaatcggtttgaaatccaataccataaatgaaaattacccctttagaacctgtattcacagtcgccatgcgccgtccaggcggtcctttcgccccgcttggcgttaaatttttttgctgggcgacagcccgtctgcaaaaatttgccttgatcaggtacaaaacccctcgcctgcccggcatcctccggctgtgaatacaggttcttatttgttgccgtccatcaggaccttccagatacattcggcgatcgccgccggtgaaaacgcctcgcggccgtctgaacagcgcaccatactccagccgcaccgttcagccgcgtaaagcgcacagacgcggcagcggcgcatataggcggcgtttgcctcatgaatatccttttttgccgcatccccgccataccgtttcatcagcagccgctccgacacatcgggatgcatatccaaaaacagcacggcgtccggttttggcaggccaagcttttcgtattcgaaatctgcgctccaatctataaatgcatcccactgtccgcgcggcagcttacccatttggtgaatcagatttgacgtcgcataacggtcggcaatgatagtatgccccgccaaatagtcatccttccaatatccgacatagcttgcaaacctgtcgaccgcataaaaactgctcgccgcataggccggcacgtcgtccgcctgtccaaattcgcccgccagatactgcttgacgagcgccgatgacggatgcgtataatccgggaaactgatgccgcgcgcggggacgcccgcgcgcgcaaagcggtccagaagcagggcggcctgtgtctgcttgccggctccgtccaaaccgtcgatcactatgagacggcccttcatgcgtcgtcctccgccttcacgccatggatgcgcgcgatatgcgcgcgcatcccgcgcgcgtcgccgcagctcattttcccttcatggcacgcgcctgtgtaacacgatggtccggccttcgaaaacagcgtcggcgccaccctgcatacaagtgaaagcatctgatcggccacctcacggatttcccactgcgcgcgcttgcagcagcgatgtgcaaagaagttcagcaagctgcgcgcattcattgtgacgatcagtttggtgtcacaggcgtttggcagcacaaaacgcgcgtcctcaatcgcctgcttctccgcgcggcgcatggccgttttttcatcgtcgccgttcgcgatgaaagcggctgtatgccgcgcctttaaaagcgcggcgatccggtcgtaatgcgcctgcgcgtcgcgcatcgcctcctcgaaagccgcggccgcctgcggatcggcctcgatttcaggcggaacgacgtaatcaaactgcgcctcgcgcacataccgctggctctgcacgctgtacgatgcgatccgatggcgtgtaagctgtgcaaggaaagctcgtgagacgccttcaatgccaaatgtaaagctcgcgtgttcgatcgggctttcatgaccgatcgaggcgagcatctgcacgaagtcggccgccttctcatcggtaaggctgtccattaaatccgcaagcgacgccggcgaataacagagcttcgccgccgccgcgatggttttttcaggcgcgggcgtgtggctaatcagcgtgacccgcaatttagccttcggcatttgactctcctcctgtttttcatttccagcccggtgaaaccaaaagacacgctgcctttcggcttcaccgggcaatcatggttacttcccgtttacgcaaaggccggtcgggccgtccgcgctgtgaatcagagctgatcgcactccgaaagcttcggggggaaaaactgattgaccgggaatttgatcttcttaaagacctcgcacggatcgtccgttgtgctggtgctttccttgtcgggcacacaataatcgtatgccgggatcatcatctgcacgcagcgttccagttgaacgatggtgaacaggccgattgtaatcagtacgaccttctgcggcttgcacacggcgaaatcgccgtcgaatttggagcagatcgacgccggaagcgtcacgccgcactcgaacatacggcctggaccgcattccaccagcttggaatcgagacacatcgggtcgacgacatgcacgctggctttgggcatattggtgttgtcgtgctcgcagcaattgcgcgcgtctgtggagcagtaaaccttgacgttgccgtcagacccgtacaggattaccttcttggcgaaggcagcgacgccgacaaccgtcgcaggcgggatcgtcggcgaggaatacgcggcgacagtcaccttgaaaaagaatgtgatatcgaccgcatagaagcctttgttaaacgggactggctcaacatccagataagcggtcaggatttccacatccttgcacttgacactgattgcgttatcaatcaccggctgcgcgcggtcggtgaagtagacctgaagatcggtcaggcaatccttgtcggtacaggaatcataaatccttccggcatctatgcatactgcttccttaaagcagttcgccccggttgcggtaacaggggccgtcttttgctctgccatatgaatcctcctagtaatgttttgagctgtactcaatacattttatgagcattccgtttatttgtgcatcagcagagaaagttttcaccggcgctgactgcctgccgggcgtttttttccgctttaagtcatgcttcttgcagcaaatagcgcctatccgctcgaaagggaccatacggaccgattttgcatctccgtaagcgcagagcagagccggtgcgtgtctccgccattttgacagaagcaaattgccttgaccatgaaggggaaaataatcgccccggccatatggggataaaataaatgccgcgcatttattttatcatgaccgcagcgcggcatgataaaattggccatcagggcggcagcgtgccgcgcacgcgtatcgccttggccatatgaagataaaataaatgccgcgcatttattttatcatgaccgcaggcattcgtcaatttacctgactctggcaggccatcttttcgcttatcgactctgcgccgccctttccgactgcccatgccgctaaaatatcatatgaaaaagccgtgctttgcacggctttttcacaatacaaaacgtattttgggaaagcaatccacaaataggttcctagtccaatccggcaagtatccggtatgtacgttccagcaaacgggtcctatacccgatttccgccgtacggccgtccaggcgcgccagcgcaggggatgtgtagcgcgcaccggcctcaaacagagcctccatgcggcttctgtttcttctgatccgtttccagttccattcaatcagagaggccaacatccacattttaattttcgccatccggcaacccacctttcattcattcgacagatagtcccgccgatcaacaaaataattatacgcaaagtaattggcgcaatttgtcgaacaacaggagatcaccgtgaataaactatgaagaatcgacggatcattcgttaattcctgcgcaatcgcgcgaatttcgccataaccttctttgttccgacagattcgaacgctacttcgacaagctgatcgttacccatcggcgtaacagacaaaaccatgccaggtccaaacaccttatgcacaaccggatcgccaggcttccaatcgcattcgcccgcctgtgcagccgatgcatagcccacgccgagcattctgtccgcctgcgtcatgcgcgggcggcgcggcggcagattttccaccatctgccgccgcagaaccgtttggtccgtcacctcgcacaactgctgcggcacctcgcccaaaaagcgtgacggacggtttcgcattgtctggccaaacagcatcctctgcgccgctgtcgagatataaagctgcttttttgcacgcgtgatcgagacatatgcaagcctgcgctcctcctcaatctgttcgggattgttcatcgcctgcatccccggaaaaagcccttcctcagcgccgactacaaatacataatcaaattcaagccctttagcggagtgcatggtcatcaataccaccatatcagcggcagaatcgtagttgtccaaatccgtgtaaagcgatatctcctccagaaagccagataaggacggctcgtctgtttcctcctcataacgatgcatcgtggactttaattcctcaatattttcaatacgcgcctgtccttcaggcccttgtgcctgaagcatacgcagataccctgtttcctcaagcagagtatccagcagctcatcaagcaaaaccttgtctgccaaatcgaccagcttttgaatcatggaggcaaaggacatcaaatcctgtgccttgcgtccaagcgatgcatattcatcggcatgggccaacacatcaaatacggttttcccctcgcccgccgcaagctctgcaacagccgcaatggtgctttcgccgatttttcgttttggctcgttgataatgcggcgaaggcgcagcgtatcggcctggttgttaatgacgcttaaataagcgacgacatccttaatttccttgcgctcataaaatcgcagtcccccaatgattctatagggaatcgcagctttggtcagaccgcgctcaatcgcctgtgattgggcgttcatgcggtaaagcaccacatgatcggcatagcgcgcgccatttttaacattctcctgaatggtatcgcagagaaagcgcgcctcctcgccttcatccgccgcgcgatagacgcgcaccttgccgcctgtatcattttgtgtccagagcgtctttccctttcgggctgtattgtgctcaatcaccgcgttagccgcgtcaaggatcgtacctgtactgcggtagttctgctcgagacggaacacgcgcgcgcccggaaacgtatcctcgaactgcaaaatattctcaattgtcgcgccgcggaatttgtaaatactttgatcgtcatcaccaacgacacacagattcccgctttcagaagcgagcaggcgcaccagctcaaattgggcatgattcgtatcctgatactcgtcgaccatcacatagcggtaacggcggcgatacgtctccagcgcatccggatattgctggaacacccgcaccgtcagcataatgatatcgtcaaaatcgacggcattggcgttttcaagctgacgctgataccgctcataaactttggagacgacctggagacgatagtcctcccccacagtcgctgcaaaatcggccggtgtgcgcagttcatcttttgcgcgtccaatttctgacaggatagaccttggagaaaaacgtttctcgtccacattcagctctttgagagccgctttaatcaagcgtatcgaatcgtccgtatcatagattgcaaagctccggccatatccgatccgctcaatctcacggcgcagaatacgcacacacgccgaatgaaaggttgatgcattgacatccgaagccacggatcccagcatcgcagcaagacggtcgcgcagctccccggccgctttgtttgtaaaggtaatggcaagaatattccaaggcataaccgtccggtttcgaatcaatgaaaaagcacggtccatatcccagctttcaccggcagcgtattcctccaaaaacgcaacgtcgtccccggtcaaatgctccggcacatgtgcacttgtatatgcgtcgccaaattgaatcatatttgcaatgcggttgatgattacggtcgtctttccgctgcccgcgccggcaagaattaacaccggtccgtcaaccgcataaaccgcctggcgctgcattggattcatttggataaaaaaatcgtcgatgatgcgccgcctgacggataaaaaacgttctgacaatgattgttccatatcgctctcctcaagttttttcctagtaatcagtttgtttcaacacccattgtaccacactttgcgctgcctgtgaacgagaaaaggacggtcctgtagaccgtccttttgtttactttgatcgaattgctattttaaacaagcggtttgaggatcgccagcagaacgccggcggccacagccgaaccgataacgccggaaacgttcggtcccatggcgtgcatcagcaggaaattcgtggggttctccttctgccccaccttctgcgaaacgcgcgccgccatcgggacagcggaaacgccggcagagccgatcaacggattgattttaccaccggtgataaagcacatcagatcgccgagcagcacgccgccggcagtgccaatggcgaacgcgcacaggccaagggcaatgatcttcaatgtctgcggcgtcaggaaacgttccgcactggcggtcgcgccgactgtggttccaaggaaaatcgtaacgatattcatcagctcgttctgcgccgttttgctcaggcggtcagccacgccggactcacggaacagattgccgagcatcagcataccgatcagaggagccgtatcaggaacgaggaaggaaacaacaaccgcgacaagaattgggaacacaatacgctccagcttggaaaccggacgcagctgctccattctgatcgcacgcattttcttggtagtcagcagcttcataatcggcggctgaataatcggaacaagcgccatgtaggaatatgccgcgatcgcaactgagccgagcaggtgcggcgcgagctgtgttgttgtaaagatcgccgtcgggccgtcggcgccgccgatgataccaattgatccggcctccgggcctgtaaagccaagcagcaacgctccgaagaaagcgataaaaataccaagctgcgccgcggcgcccatcaaaaagctcttgggattggcgatcagcggcccaaaatccgtcatgcagccgacgccaaggaagatcagcggcggataaatgccgagcttgacacccaaatacaaataatcaagcaggccgccgctgtttccaagctgctcccataggatatgccccgtatcgttgatgaaaatctcaggatggtacaggccggccatcggcaggtttgtcaaaagcataccaaaagcgatcggcaacaaaagcagcggctcaaagccccggccgattgcaagatacataagaacaaatgaaacaagaatcatcagcgcctgaccgccagtcagattcataaaacctgaaccgttaatcagcttctgcaccgaatccaggaaaatctcaagcatgttgtcagccctttcgtttaaaatgcggtttttcgtccgtacatgccattactgccaacataagcagttccgccgtttaaaacggctgcgtgttctgggcaagtcctgcctgcgaccacgccgtgcgttcggtgcggcggatgctgcgaacgacaaatccgctctctaaggcgggcccttcaacagccgggacgggaattaccggagaaccggtcattgcagcgatcgcagccgtgatcaccgctacaatttcgtccccaattccatcctcaaccgccatgacaggctgctgtaccacaggcgccggcgcgggcgcgtcggctacccggatggcaggcggctgcacagacgcctgctggggcgctgccttcggcggctccttcggcgccggcggcgctggctgaaccggcttctgcggctgctttttctgcgaaatcgccgtgaaaatcttgcccataatggccacaatgaaccacaggccgatcaatgcgacaaacacgacgacgagtccggtgatgataaccgcacccgcaagggtcatattttccataataattctccttgctattttatttttatgtttattaactacaattcaattgctttcctcaaaaaatcgaaactagaatttattatacaatatcttgtggtgatatgcaattgcttttccaaaaaattttgaaaaaattttaacaaactttggcctgttcatttccacgtacacaatttagacataaaaagcgccgcccatataggcggcgctttgtgaacttttaccaatcgaattacataagcgatttcatgtagcgttcgtatgcctcgcgcagctcctgcgctgtctgctccggacaggtcggattgcagtgcgcccaaacgccggtttccgacgaggcattgtatttgattttgtccgcgctgcgcatcggcgggaaaaattcaatgtggaagtgatagctttcatggacatccggcccattgaccggcgcgttgtgcatacacatcatatatgggaacttgtagccgaacaaactgtcgagcataccaaccgtgtgcttgaccgtcacagccagcgcacggcgctcctgctgcgtgaactcatccagattgctcttgtgcgaattggcgaagatataaacgccatatggatattccgtaaagaacggcaaaaacacggtgaagtgttcattggaaaagatgacgcgcttttgaaaatcaagctccgccttgagcatatcgcagaacaggcagcggcccttttcttcaaaataaccgccggaggacgcaagttccagctcgatctttttcggcacaaaggaatatccgtaaatctggccatggggatgcggcatcgtaacgccgaccgcctcgccgcggttttcaaagataaacacatacttgatcccttcatcctgccgcagtgcgttaaaccgctcgcaccacagatcgaccagcttctccatatgatcgtccgaaagctccgggacggttgtcgtatgaccgggcgaataaaggatcacttcgcattttccatatgccggcgccgttttaaaaaaatcgttggccacatcgtcgggtgcgggcgggtcctggctcaacgctggaaaatcgttgtcgtatttatagacgtcataatgctccggcaccttgccggagccgggacagaacggacaccagtccttgggcatctgcggccgtgcctgccggtgcgaagcaatcatgacccaatcctgtgtaagcggatgccatctcaattctgccattgtcgattcctcctgttcatcagttgctgttatgcgccaagctttggtgtgatctcaacgccgcccacaggacggatcgaaagcacatgacagcttcccgctccaaagacggactccatcctttcccggtacgcttcgagcagatcgtccggtacaaagctctgtatggtgccggcaaagcctccgccgtgcacgcgccacgcaccgcgtcccgcaagcagatgttcgctcatggccaacgcgagcgaaagcccttgctcgtccggatttttgcaggtataaacgttttgcagatacataaacgatgagcggccgctttcaatgacaagcgccttgaacgtctcaaaatcgccggcgcgcagcgccgcgacctgacgcggcacacgcgcgttgtcgccgtagaagtggaaggcgcgcagcagcgcgcggtcggtgcatttgccgcgcagcgaagcgacacgcccgtaaaatgtctccggcgcgatatcccgcagcacctctttgccgagcgccctggcgacagaacacatctcgacagccgccgacgcataatcgtctgtcagatcggcgtgattgcctcctgtatcgacgatacagagcttatagccggaacgcgcaaagtcaaaatcaaccttttcaacaacaggcttttcagggtcagcgaaatcaatcgtaatgaacccgcctactgaacaggccatctgatccatcagaccgctcggcttgccaaaataaacgttttcggcgtactgtccaatctgcgcaatctgtacggcgtcgaccgaaccgtccgcatacaggctgccaagcatcgttccaacgatcgtttcgaacgcggccgacgacgacaaccccgagcctttgagcacgtttgaggttgtataagcgtcaaatccggcgaccggatgtcccatcgcagcaagccgggcggccacgccccggatcagcgcggcggctgtgttgcgctcgtcatcgcgcgccgacagatccgacaaatcaaccacatccatcggaaagccctccgacttgatgcggatgatccgatcgtcatttttagacgccaccgcaatcacatcgaggttgacgcccgccgccagaacacgcccgtgctgatgatccgtgtgattcccgcccacctcggtgcgtcccggcgcgctgaacaggcggatctcacggcccgcgccgaacaatgtttcaaactgcagcgccgcatttttatagcgcgcgcgctgctcctgcgctttttcgctgtaaagatagccaaacgcctcatcaaatgctccgctgtcaatctttgtcatcgtctcgatcgtatccatctgttgacctcccatcttttggatgcgtctgccggatgtcacgtccaaaatttcctgtttcctatagcttaacgcaaaggcggccctattacaacagaaaaaacaatcatttttatggatttttgttgcgtcggcgcatagacttctgatatgatgtcaatagacattcatgatggcgggagggcgtaaacatggcgtccgggattttcaagcattcctataaaacaaaaacgcgcgaaagcctgccgattgcaatttataacgccggagcgcagcggtgcgagccgttgtatgcctggggaccgggcctgcgcgaccattttctggttcaccatgtgatcgtcgggcgcggcgtttacacggccgacggcgttacgcatgacgtaaaagccggcgatacctttatcatttatccatctgttgtcgtaacctacagcgccgacgcagccgatccctgggaatactgctgggttggcttcaatggcgcggaagcgcgtctgatgatcgcacagactccttttacacgccaacggcctgtcgtccggtttgaacagcctgatgaaatccgcgaagccattgccgatatttaccgtgcgtcgggaaccacgcgatcaagcgaactgcgcgcaatcggaatgctatacatctttttggccctgctcatcgagcaggccggtgcgcccgcgccggccgccggactgtcgctggagtatgtcgaaagcgccatccggtttatcgcacataactattccggacatatcgacatcgaagcggtcgccgcctctgtcggcatcagccgaagccatttgtaccgcgtctttatgcagcatattagcacgccgcccaatgaatatctggctaaattccgtatttcacaggcgtgtgagctgcttggccattcctcgctgcctgtttctgcggttgccgcttccgtcggctacgacgatccactttatttttcacgcgtatttaaacgaatcaccggaatgccgccgtcggcctatatcaaagcgcaccaggccgggacttaagcgccctaacgaccacaggccgcatctttttgcggcgccgtccggcggctgcattccaaacgcaaggaggcttttccatggaaactgatatcgcaaatgctctcgaaacaaattcaaccgccgccgaaattcaaagcgcggtcgacgccatcgcacagatgccatcgaacacacggctgcactatcttcttggaaaatttttagatctgctgcccaagctcttgacggccgcgctgattctgctggtcggcatcatccttgtgcgctgggccgcaaaatttgcgcgcaatctgctcaagcattcccggctggacgtaacgctgcataatttcatcgtttcaattctcagcgcgctgctctatatcctgttggccatcatcgttgtaaccgtgcttgtgccttcagccgccgggtcgctgatcaccatgttcggcgtgtttggccttgctgtttcgctggcagtcaaggattcgcttgccaatctggcgggcggcatgtcggtcctttttacaaagccgtttgcacttggcgactatgtcaatatcaacggcaacgagggaactgtccaggaaattcgtctcaactatactgtgattaaaaccgtcgacaacaagctggtacatatcccaaacggcgatgttgccaaggcggagatcacaaactttaccgcgcaggagacacgccggctcgaccttgtattttcaattggttatgacgatgattttgaacaggccaaaaaaatcatccgtgaaattgtgcatgacaatccactggcgcacagcgaccctgaaccgattgtccggatggtggagcacggcgattcagccatccggatcgggtgccgtgtctgggtggatacagccgactactggacgctgaattatgatttgcttgaggaggtcaagcggcgttttgacgcctccggaattcatattccatataatcaattggagattgcgatccgccgcgagccgtagtattttgcttcggccgcgtcagttgtaagagcatgggcgcgccaaagcgtccgttttttcagaaaaggcccgggaaaatcccgggccttttctgcacgtccactgccggaaactcggaactgaatccggctggccgcacaggaagtaatgagggcattttgaagccgtgccagcatccaatttgtccccttttgattatatatccaaattatttaaatttcaatttaaatattaatctaaaatttaattgtatatatagtttataatcttgtctataatctggacaggtgatgttcatgtttcaaattgaaaagccggaaaaagtcaaccgcaccattttcatccccaaaagtctgttggaacggattacaaagctttctcaggaaaaggatgtctccgtcaatcaaatcattattcaatgctgtgaatatgcgctttcgcatatggaggattgcggcgcggagccgaaaaaataagccggaacgcgagcgctccagctctttcggtcaaaccgaggctgtactctgtccgaaacggcggcggcacgcatcgatctgcgcctgctgtacaggctctgacgtgtaccagccgcgtttgagcatttcatcaaatacctcgtgctgaatttgatgttcctcattcagaatcgtcatcagctcccccataacggcgggggagacgcattcatttgcataaaggttataaccgtgcgctgcaaacttctggcttgccagcgcatcctccatcatctcgcggtcgccgaatggaatctgccgcatactcacttgccgcctccctgcccaagctgtgcaagcagccggttgtaatgattctgatggcgcgctgaattgttttcaaactgtgtgcgcagctgcggatcagaggccatgtgcgcatacatggtgaattttttgatcagcgtctgttcaacgccaagctgatcctcgatcgcggccagctccttggcggttagcgacatatgaaaaacctccctgaattagtatcgctaaaagtatgccaattcagggaggtttttatacggctgctataaccgcatgatgattcaaaacctgtattcaatttttatgcggcgacgatgtgataaagccatcgaccagccggccaatatattcaaatgaccggcctgtaccgatcgcaacgcattccaccggattctcagccagtccaaccggcatcttcagcttggcgctcatgtgcttgtcaagcccatgcagcatcgcgccgcctccggtcatcaccatgccgttttcatagatatcgccgacaagctccggtggcgttcgctccacaacagaatggaccgctgcgcggatctcctccacaagttccagcatcaccggatacagctccgaacgcgacagctccacgcgcgtgggcagacccgtcgccaaatggcgccccttgatctcataagtcagattctccgcgtccgggtcaacgctcgcaatcgcaatttttacccgttcagccatgcgctcgccgatcagaacattgtatttgctgcgtacatagcggatgatcgcagcattaaacttatcgccggccagcttgattgaatttttacagacgattccgttgagcgacagcacagcgatatcgctggtaccgccgccgatatccaggatcaaattgccgtttggctttgatatatcaagtccagcgccgatcgcagccgccaccggctcctcaattagataaacgctgcgcgctccggccgcgccggctgcgtcaacggcggcgttcgcctccacccctgtaatcaacgacgggatacacagcgcaacgcggggcttgaccacattgcttgggcaagccttcttcataaagtatttaatcatggcttccgtcatcttataatcggaaatgacgccgtcgcaaagcgggcggatcgccgtaatgcgggcgggcgtttttccaatcatctcatgcgcctccgcgcccacgctgagcgtttcgcccgttttcgtattgaccgcgacaaccgacggttcgcgcagaacaattccctgcgaaccattgtaaacaagcaccgtcgaggtgccaaggtcaattccaatgtcaatcgaactcatgtttagacctcccgccggtttttatccggcatcttttgtccggaatgaatcgcgttatgtcccaaaaggcaagctgataaacctgccgtaatgcggcataattaccctgtccataaagatgaatcattgcccatcgaaaggcggttgctgcgtgcacaccggtataataaccgcagagcagcagctaaaccagcggagctggtttttgctgtggtgtaccatgcgcagtccgctgctttgcagcgtttgcactgcgcatattataccgtatttttcgccttttttcaacgctgcattttgcagcctctgtgcgcacgcggcgtcgtcatcgctgtgactacataaacggactgtgcgccgcgttcaagcagcagcgcggcgcagcggcgtaccgtcgcgccgcttgtcagcacatcgtcgataagcaaaaccgtcccgccatcaatatgtctgcctttacaggctgcaaatgcttggcgggcatttgcctcgcgtgcatcaaagcccttctgctccatctgcgcgccgcccagtcccgtatgcacgataaatccatcggacacaggcagtccaagccgtttggcgagcgcccgcgccagcagctccgtctggcaatagccgcgctggcggcgttttttcgggtgcatcggcacatacgtcacaaaatcgaatgggatatctgtaaagtcggcgcgcacacgccgctccatcaacgcggccaaaaatggagcataatatgaccggccgtcgtatttgaagcggtacatcccttctcgggcgctgccggtataaagcagtggcgccgtcgcaccggcataaactggatcgcatcgcccgcagatacaatcagccgccggctttccacagtgcgtacataatacgcccgcatacggcggcacacactccccgcacagccaacccgttcccgcaagcacacgtccgcacagaaagcatttatgcggaaacaaaagcgtcaatgcctgctcccaaaacgcgtcagccaccgcacacctcgtcgagcaggtaacgcagattcgtataccggcgcgaacgtttgtggttgtccaccatcgttttaacggccgatgcggaaccaaggataatcaacagcttttttgcacgggtaatcgcggtataaagcaggctgcggtagtacatccggctttttccctccatcagcggcagaatcaccgcatcgtattcattgccctggcttttatgaacggtgattgcgtaagccaattcaagctcattggccatatcgaatgaatattccgccaggcggtcttcatcgaaccgtacaacaatcgtggcgctgggccggttaatcaaatcaatcacgccgatatccccgttaaagacgcccataccgtcctccccgccatccttctgccaaaccagatcgtagttgttacggatctgcatcactttatccccctcccggaatgtgaccggtccggaaacatattccttcttattgggggacggcgggttgactgcattttgcagcacgcggttcaattccgccgtgccggctgcaccgacgcgcgtcggcgcaatcacctgaatatcccacatcggggaaaatccgtaccgcttcggcaggcggcgcgcgtacaagtcggcggctgtcgcgcaggcatgtgccgccaaagtatccggcagaaagaaaaaatcattgtcacgcacgtcaagccgaggatattcccctgcgacaactgcatgtgcatttgtaacaatcaggcttttggccgcctgacggaatatctccgtcagatgcacaaccggcagatggccgcctgcgatcagatcacccaaaatattacccgcgccaaccgatggaagctgatccggatcgccgacaagaatcagcctgcacgaaaatttcagcgcgcgcagcagcgattcaaacagcagcgtatccatcatcgacgtctcgtcgatgatgaccgcgtcaaacggcagcggattcttctcattgcgcttaaatttcgtcaagcccgagccatcggcaaaatcgacctccagcaggcggtggattgtttttgattccgcacctgtcaattccgacatgcgcttggccgcacggccggtcggagcagccaacgccaccttttcccccatcttcccgagcagccggatgatcgccgagatggccgtcgttttaccggtgccgggtcctccagtcaggatcatcagcggcgatgtgaccgctgtaacaatcgccatacgctgaagctctgcatagacaatgccgctttcacgctccagcctgcctagaatctcctccatatccggcgcgtgctccgcagcgcctttggagagcatcagcgacaatcgattgacgatacagcattccgcctcataatagcgcggcaagtatagaaagctgcgatcctttacagccagccgcacaagctcgccgcgcgcaatcagctcctccaacgcgtccgaaacatgataggtatccgtctccacaagcagcgcggctgtctccagcagcttttcctccggcaggcaggtatgcccgttatgaaagacattgtggcgcagcacatgaagcagccccgcggagatccgttcatagctgtccggcgccaatccacttcgttcggcagccgcatcggccagctcaaacggaacgccgatctcctcgatacagagcgcatagggattttccgacacgatttcctgtgccgcagtcccatattttttccatgttttgatagcatatggcgcaggaatccccaatttttcaagattcaacattacagatcggattccaaaaagcttcttatactcattggaaatttgttccgcttttttgggcgaaattccctgtatctcagcgagctttgccggattttgttccatcactgtgagcgtgtcatcgccaaaggcacggaccaatctgcgtgcgatggcaggcccaacgcccttaacagcgcccgacgacaggtagcttgcaatcgcggaggccgttgccggcatcaggcgttcatacgcttccgcgcgcagctgcataccatatttggcatgcgtagtgtaggccccggttacaatcaatgtctcgccaaccgcaatatccgaaaattcgcccaccactgttaaaagctccgcttctgttgacagctccaacacagtaaacccgttttcctcgttgtggtaaacgatcgtctccacgctgccttccactctgtaacgctcgccggcctccaagatttccgttcctccccgctctgatctgctttgttccattataatacagatttcgcggattgtaaacgcgcctgccggcttcggcgcgcgcgacccgtgcgcgggtcgcccaccgccggccgcttcgcttgcccggccggctgttcggggctttccggcgctataaagcgccgggcgcggacaagccgcggcagcgccccttttcgcgcctcacgagacaggggcgggccgcccctatcccgtgaacccaaccccggggcagggtacagcctgtatacgcgcagcgtccgccccactgttcacggcgcagcctgtataaataccggaacccgccccactgttcgcggcgcagccgattaaagtttttcgccgaagccttttttcaaaaaggctggagcgcagccggctaaagttttttccaagctttttttcaaaaaaggtgggaacgcaatcgggcatcaagctcggatggagagcggataaaggctgcgccggcgctttgagccagaaccgcgcagtcgcgcgcgccggcttcgtcaagcccaacatcataaagaataaaggattcacggcttggattcgactcccactgcaaacaggcgtaaaacagcgacatttgatcgcctgcacgttcgccgccgatcggcacaattttgtaaatgcgattacctttacagcttagacgaaccgcaatccatgccgccgtatgtacaaatccgatacaagccaacgccacaaataaaaaccagcaaactgtgtcgatcataaaaaatcacctcgaaaccatcgtatgttccgaggtaattttatgttcatggaaatttgcgcttattccctgacagccgctaaaatcgcatcaactttatctgttttttcccagtttacgccaagctcctcacggcccatatggccataagcggcgagctgccgatagatcggacggcgaaggtccagagaacggataatgaccgccgggcgcaggtcaaataccttattaacagcctcagcaagcttttcatcgctgaccgcgccggtaccaaacgtattgacgttgaccgaaacagggcgcgccactccaattgcataggcgagctgcacttcgcagcgatgcgcgagctttgctgcgacgatgttcttcgcaacccaacgcgccgcatatgcggccgagcggtcaaccttggtcgggtcctttccggaaaacgcgccgccgccatggcgtccgaacccgccgtatgtatcaacaatgatcttgcgcccggtcaacccggaatccccctgcggcccgccgatgacgaaccgtccagtcggattgacataaatctttgtatcagcatccatcagccccgcgggaatggtaggcttgatcacatgctcgatcacatcggcgcggatctgctccagtgaaacctccggcgcatgctgatttgaaataacaaccgcatcgacgcgcaccggtttgtcgtcaacatattcaaccgtaacctgagttttgccatcgggacgcagataggcaagcgtaccgtcgcggcgcacctgcgacagccgcttggccagcttgtgcgcaagggaaatcggcatcggcatcagctccggcgtctcatcggaagcatagccgaacatcatcccctgatcgcccgcgccggtcgtatcggcttcgtcgcaggcgccttctctctgctcaagcgctttgtcgacgccctgtgcgatatcgccggactgctcgtcgatgcttgtcagcacggcgcaggtctgagaatcgaagccaaatttggcacggtcataaccgatatccttgataacgctgcgcgcaagcgctgggatgtcaacatagcaggtcgttgaaatttcgcccataatcattaccatacctgtggttacagccgtttcacacgccacacgtgcgcccgggtccttggcgatgatcgcgtcgagcaccgcatccgaaatctgatcgcagattttatcgggatgtccttcggtcacggattccgatgtaaataaatactttgtcatatagaatgctctcctttctatcgtgacggccctccctggcctggtcaatcaactcagcagcgccaataccccatcactgacggcgttggccgtgcgataaatcccctgccgggaagccatgctgtcgtattcggccggattcgttacaaatcccatctccaccaataccgacggcgcaaaggtattgagcgtcacacggaaatttgactgtttcggaccgcggttggtgcgcgaggtatattcagacagatttgcggacagcgttgctgcaagctcttttgcgatactctcgtaatagtaaacctctgtgccgccaatcttgttcatatcctgggaatagttcaggctgttgcaatgcagagaaataaagaaatccgcctcataagcgcgcgtcaaatccatacggtcgttcatggatacatcgctgtcatctgtgcggcacatgaccacatgcgcgccaagagattccagacgcttttgcaccgcaatggctgaagcgagcgtgatatccttctccattgcgccgtctgtacccggaatcccgattgctcccggatcagtgccgccgtggccggcatccaccgcaattgtcactccggccaaaggctggccgcctccggacagacgcggcgcatatttcgcataaattaaaatatttccgtcctcataactgatatcgtatccccacagacggcgctgaccgctgagcataaactgcaaaaccgtactgccgtcctcctccgtaaccttcaccgagctgaataatccgctgtcagcgtaaggcttgatagattcgacacctgtcgtattataaagacgcacaaacagtttttccccatccatataagcgcggaacatgggattggccgtcccgtgcagcgtatatgtctcgcccttttctgaaacgtcaatcgttacatcggacaccttgttttttaaagaaacactgccggtgagcggacgcaccgacgaacgcggaatccatccgccggttgaaagcctatacaggtttcctttgatctccgcgaccaaatcggtgccgccgcggcgcggcgattcaataaatgcgctcatattttcatccagatataggctcgcagccgcattcttgacctgaaccacaagacggccgtcaccgttgataaatacgctgccctcggaggtggcggacgccgtttttccattgtactgcatcgtgtaggtgacaggacccagctcctccgtcccgttagcggacggcgcggttaaccgcgccgaaaatgtagcaggaacgcctgcgcgggccgtagccgccgcctgtttgagcgaaaccgtgcggccgccaaccttggctgttaccgttgctcccgacggcgcaatacacgataaagtgatctcatcgcccgaataggccgcacaatcgtagtccggcgctggtgaacgcacgtcgctgatggttgcaaccacgtcagcgcccttggtgatattgactgtggctgaagcgccgccctgacggaacacaaatgtattcacaccctcgtcaatcgacacaagcacgccaaagctgccgcccgcgccgcgaaccgcaacagtttccccgttcattgtcaacgattgattcgggtcggaattacctgtgataaaatagctggaagccgatgttgtcagatcgtccgcaggacgcgtaatctttaattggccgccagtatgcaaattgacatggcttgtaatataatcaaaatcgttatagctgtctgccgcccatgccgctggtgccatccccaaacaaatgcacagcgcgactgaatagctgagaagcttcttgccaaatgaatgatgctgcataaaaaaacctccttcaaacccctttttcagcgcgtccgccaacggctggacatacaccatttacgcagtgcgaaaaaatcgacagattcctgcgcagagcgacaaaaaaacgcccggttgaccgccgggcgtttttatacatcctcatctctcggtcataccgctggatttggcaccttgcaatatgcaggttgccgggcttcacagggccagtccctccgccgctctttataaggtagaagcatattcatttttaaattccgattttattctacacgatgcgcgcggctttgtcaagcgttacaccgtctgaatctcaaacctgacaagacgtgctacaggtttataaaccaaataagtcaccgcagcattgatgcctgcttttacaaggttaaagggcacaatcactggcagcagcatggggataacagcgtcaatcggagtgcccataaagatcggcgtaaaaatcaggttgcagccgaccataacagctgtcatcgcaagcacgcctgcaagcaaagccaaggccgcgccgccgcgtgtatgacggcggcggtagatcgtccctgccagcagcgcaaaggtaccggtcgccagaaagtgcatcacgataccgatccaccccgaacctgcgctgacagtcgtcccctggataatcgctacaaccgcagtcaagccaagccccgccgccggaccaaacaggaatgtgccgatgaagatcgggatatcagcgggatcatattccatccatggcgccgccggcagcagcgggaaatgaacgaatgccaccagtacgattgaaatcgctgtgagcatagccattgtggtgagtttgcgtgtcgcttcgcttactttcatatgtgaccctccaaattatgttggagcctgccggggaaaatgaaaacacccctgcgcgcagcgcaagggcgtgggcatatcggcggaaatccgcgaatacatgccgtttctttcatccggactattaccgttggtatgggaatttcacccattcagccggctttcgccgggtcgcggactttaccgccagtgaggacttgcacctcgccctgaaacagacttttttcgtaatttattatagcacgctccgcgccattgtcaagtgtatttgataaaaatttgacgataatctgcacaaaacaagcgccccgcatgcggggcgcttgttgttaaaaaccttattcgttgatcttggtgacaacgcccgaaccaaccgtgcggccgccctcacgaatcgcgaaacgcagaccttcctcgatcgcgatctctgtgatcagttcaacgtccatctcgacgttgtcgcccggcatgcacatctcggtgccttccggcagcgtgatgacgcctgtgacatcggtcgtgcggaaatagaactgcggacgataattgttgaagaacggggtgtgacggccgccttcttccttcttcaggatataaacctggccacggaacttggtgtgcggatgaatggagccgggcttgcacaaaacctgaccgcgctcgatctcggtgcgctgaataccacggagcagagcgccgatattgtcgcccgcctcagcgtaatcgaggatcttgcggaacatctcgataccggtaacaactgtctttttacgctcctcggtcagaccgatgatctcaacctcgtcgctggtgcgcaactggccacgctcgacacggccggtcgcaacagtaccgcgtccggtgatcgtgaagacgtcctcaaccggcatcaggaacggcaggtcggatttgcgctccggagtcgggatatagttgtcgacagcatccatcagctctttaatgcaatcgtaagccggatcgtccggattgttgggggcctcgagcgccttgagtgcggaacccttgatgatcgggatctcatcgcccgggaattcatacttggagagcgtctcgcggatttccatctcgacaagctcgatcatctcctcgtcgccgtccatctggtcgaccttgttcatgaaaacaacgatcgcaggaacgccgacctggcgggcaagcaggatgtgctccttggtctgagccatcgggccgtccgtaccggcgatgaccagaatcgcgccgtccatctgagcagcgccggtgatcatgttcttgatatagtcggcgtgtccggggcagtcaacgtgcgcatagtgacgcgcatccgtctcatattcaacgtgcgcagtgttgatcgtgattccgcgctcgcgctcctccggagccttatcgatcatgtcataagcctcgaactgagcctggcccttcagagacagatacttggtgatcgcagcggtcagcgtggtcttgccgtggtcgacgtgtccgatcgtaccaatgtttacgtggggcttgtttctttcaaaatgtgcctttgccatcgagaatgttcctccctttaataaagactttttgtttcagaagaatagcttgctggcgctgaaacgacacgccttgtctatgatttgtattctaccaattcacagggaaaaaagcaagcgttattcggcttttttgccgcgcgtgctcataattccctcggcgatcgacttgggcacctcaatgtagtggctcggctccatgacatagctgccgcggccctgcgttttagagcgcaggtcgttggagtagccaaacatctcggaaagcgggacgaacgccttgatctcctgggcgccaaaaacggcttccatgccctggatctggccgcggcggctgttcaagtcgccgatcacgtcgcccatataatcctccggcgtattgaccgtaacgcgcatgatcggttcaaggatgaccggatcggcctttgccatcgccattttgaaggccatggaggcggcaatcttaaacgccatttcagacgagtcgacctcgtgataggagccgtcgtatagcgtaaccttcacatcgacgaccggatagccggccaaaacaccggcctgcatcgcgccctgaataccctgatcgatcggcccgatatactctttggggatcgcgccaccgacgatcgcgttgacaaactcatagcctttaccgctctcgtttggctcgatcttgatcttgacatgaccatactggcccttaccgccggactgacgggcatatttgtggtcgacatcggccattttgcggatcgtctctttataggcgacctgcggcttgccaacattcgcctcaaccttaaactcacgcaacaggcggtcgacaatgatctccagatgaagttcgcccatgccggcgatgatcgtctggcccgtttctgcgtcggtataggtgcggaaggtcgggtcctcctcagccagcttgctcaggccgatggccatcttttcctggccggccttcgtcttgggttcgatcgccaagtcgataaccggctcagggaattccatggactcaaggatgatcggatgcttggggtcgcagagcgtatcgcccgtcgtcgtatttttaagaccgacggccgctgcgatatcgccgcagtaacacgtttcaagatccttacgatggtttgcgtgcatctggaggatgcggcccatacgctcggaattctgtttattggaattgtaaacggatgttcccgcatcgaccataccggaatagacgcggaagaaacagagcttgcccacatacgggtccgtcgcaattttgaacgccagggccgcgaacggctccttatcgcccggcttgcgctcctcctcctcctccgtctcagggttgacgcccttgatgttcggaacatcggtcggcgcaggcatgaaatcgacgatcgcatcaagcagcttctgcacgcccttatttttgtaggacgtaccgcagcagaccggaacaatcgtgttggcaatcgtggccttacggatggccgccttgatctcgtcggtggaaatttcctcgcccgcgagatacttctccatcagggcctcatcctgatcggccaggctctccagcagctcctcgcggtactgctgcgccttttcgagcatatcctccgggatctcctcgacgcgcatgtcctttccgaggtcgtcataatagacgtcggctttcatctcgatgaggtcgataatgcccttgaagaaggtttcagcgccgatcggcagctgaatcggaaccgcgttacatttcagacgcttgcgcatcatatcaataacgtggtagaagtccgcgcccatgatatccatcttattgacgtatcccatgcgcgggacgttgtatttgttggcctgacgccaaacagtttcggactgcggttcgacgccgcccttggcgcagaaaaccgtaaccgagccatcgagcaccttcagcgaacgttcaacctcaactgtgaagtcaacgtgtccgggtgtgtcgatgatattgatgcggtggcccttccagtaggctgtggtggcagcggacgtgatcgtaatgccgcgctcctgctcctgcgccatccagtccattgtcgccgtgccttcatgtgtctcaccgatcttgtggttaatccccgtataatacaggatacgctcggtggtcgtcgtcttgccggcgtcaatgtgggccattatgccgatattgcgtgtcatttccagagatacatctctaggcatagtgtcctcccttatttcttgcgctccgacgccggttcagcagccgctgacgccgccggtaaaaatcaaggcgcataggttgcgccgccgtcaggcggcgtgcaggcggaaaactaccacctgtaatgcgcaaacgccctgttggcttccgccatcttgtgggtatcctcgcgctttttgacggcgccgccggtttggttgagagaatccatgatctcgccggcaaggcgctctctcatggtcttttcaccgcggttgcgcgcgtatgtcgtcagccagcgcaaaccgagcgtctgccgccgctccgggcggacctccatcgggacctgataggtcgcgccgccgacacggcgggccttgacctcgaggacaggcatgatgttctccatggactgctggaacgcttcaagcgggtccttacccgtcttttccttgacgatatcgaatgcgccgtatacgattttctgcgcgacgccctttttgccgtcatacatgatgttgttgatcagccgggtgacgagcttcgaattgtacagcgggtccggcaaaacgtcgcgttttgcaatttgacctcttcttggcacttcgcttccctccttcacaattataatgaaatcattggtactcgaaagtgacaaaactcccgttcgcgccaatcatcggcccatctatatggtagccaatcactggcagaataatcagcagttttattacttcttggcaccagccttcggacgcttcgcaccgtatttggagcgggcctgcatcctcttggcgacgccctgcgcgtcaagtgtgccgcggatgatgtgataacgcacaccaggcaggtccttgacacggccgccgcggatcagaacaacgctgtgttcctgaagattgtggccgataccggggatataggatgtgacctcgaaaccattcgacagcctgaccctggccactttgcgaagcgcagagttcggctttttcggcgtggatgtacggatcgccgtgcacacgccccttttctgcggcgaagtctgatcgatggcaaccctctttttggcgttccatcccttgagcagcgcgggagccgtggatttcttggcagtcacttccctgcccttacgaacgagctgattaaaggttggcatattgcacctccttacaaaaaaatgtggactttatttcacggggcaaagcggctgctttgccccggtgaaaccgtgtctgtgggccaatcccacagtatttgattatagctctttcaaccacttgttgtcaatacatacagtcagattttacatatttcgtatgattgcacaacaaagctgtctcatcaggcgggctgcatatcgtcggcgccgctgatgttggcaataaactcgtagtcgccgtggtcggacggtccgcccgcgttcacaagctcgagcgaatcgtaggaaaccgtgccggtgccagccgggacaagcttgccgatgatgacgttttcctttaatccctggagcttgtcgaccttgcccttgatcgcggcctcagtcagcacacgtgtcgtttcctggaaggaagcggccgacatgaagctctccgtcgcaagcgacgcctttgtgatgccgagcagaaccggcagccccgaagcgggacggcgcgtaccgccgtcctcggcgtttttacgctcaatttcagcgttgacgcgcagaagctcgctcttgtcgacattcgcgccggtaatcagcccggtgtctccgccgtcgtcaatcttgaccttgcgcatcatctggcggacaatgacctcgatgtgcttatcgttgatgtcaacaccctgtgtccggtacgttctctgcacttctttaatcaggtagtcctgaacggccagatggccggaaaccatgagaatctcattcggctcgaccgcgccttcggtaatcatgtcgcccttgcgcacaacgtccccttctgagacgcgcagtgtcgatccatagacgacctgccgctcaaaacgctcgccgtcatcggcggtgacgacgacaaagtcgccgcccttctgatctttctcgaacgaaacgatgccgtcgagatgcgaaatgaccgcgctgtttttcggcttgcgcgcctcaaacagctcctcaacgcgcggaagaccttgcgtgatatcggcggcggacgcaataccgcccgtatggaatgtgcgcattgtcaactgcgtgcccggctcgccgatcgactgcgcggcgatgatgccgaccgcttcaccgacgcccacaggctgcccgttggcgaggttcgcgccgtaacatttggcacaaacgccgatttttgattcgcaattgagcggcgtgcggatcttcagctctgtgaagcccgccgccttgatgcgctgcgcgtcggcctcggtcatcatctgatcgcggctgacgatcacctcgcccgtattcggatcgatcacgtcgtcggccgcgtagcggccgatcatgcgctcgacaaagtcctcaatgacacggccgctgtcgacgatgtcgcagacgacaatgccctcatgcgtgccgcagtcatgctcgcgcacaataacgtcctgagagacgtcgacgagacggcgcgtcagataaccagaatccgccgtgcgcagcgccgtgtcggccaggcccttgcgcgcgcctcgcgaggaattgaagtattccagaatgttaaggccctcgcggtagttggccttgatcgggatttcgatcgcacggccggatgtgttcgcaatcaggccgcgcatgccggcgagctggcgaatctggtccatcgaaccgcgggcgccggaatcggccatcatatagattgggttgcgctcgtcaagtgtcttttgcagcgcgtccttgaccttggccgtgcagtcgttccacgttgagacgacgcgctcgtaccgcacatcctcggagataaagccgcggtcatactggcgtttgatcgcatcgacctgcttgtcagccgccgcgatgaactcggccttttcgggcgggatgaccgcgtcgtaaacggcgacggtgatcgccccgcgcgtggaatatttaaagccctgcgccttgatgcggtcgagcacctcggccgtcttggcggtcccatacgtgcggatacagcggtcgatgatctttccaagttccttcttgcgcaccaaaaatccgatttcaagatcgaacacatgctccgggtcgttgcggtctacatagcccaaatcctgcgggatggggtcattgaagatgatgcgcccgaccgttgtgtcgatgatatgcgagacgcgctcgtcgccgacctggcgtgtgacgcgcaccttgatcggcgcatgaagtccgaccgcgcccgcctgatacgccatggtggcctcgttgaagtcgcggaataccttgccggcgcctggctcctcctcgcgcagcatcgtcagataatacgagccgagcaccatgtcctgcgtcgggacggtgacgggctttccgtcggacggcttgagcagattgttcgcggcgagcatcaaaaagcgcgcttcagactgcgcctccgcggaaagcgggacgtgcacggccatctggtcgccgtcgaagtcggcgttgtaggcggtgcagacaagcggatggagcttgagcgcgcggccctcgacgaggaccggctcgaacgcctggatgccgagcctgtgcagcgtcggcgcgcggttgagcagcacgggatggtccttgatgacgacctcgagcgcgtcccacacgtccttgacgctcgcgcgctcgaccattttgcgcgcgtttttaatgttggtggcaaccttgagatcgaccagacgcttcataacaaacggcttaaacagctcgagcgccatttccttgggcaggccgcactgatacatcttcagctccggcccgacgacgataacggaacggcccgaatagtcgacacgcttaccgagcaggttttgacggaaacgtccctgtttgcccttgagcatatcggacagcgacttgagcgggcggttgctcggccctgtgaccgggcggccgcggcggccgttgtcgatcagcgcgtcgaccgcctcctggagcatacgcttttcgttgcgcacgatgatgtcgggcgcgccaagctccagcagcttcttcagacggttgttgcggttgatgacacggcggtacaggtcgttgaggtcgctcgttgcaaaacggccgccgtcgagctgaaccatcgggcggatatccggcggaataaccggcacaacatccaggatcatccactcgggccggttgtggctctggcggaacgcctcgaccacctcaaggcgcttgagcagtttgacgcgcttctggccggcggctgtttcaagatccgttttcagttcctccgaaagcttgtcgagatccagctcggccagcagctccttgaccgcctccgcccccatgccggcgcggaaatcgtcctcatacgcctccttgaggtcgcggtattccttttcggaaagcagcgtatattttttaagattcgtaacgcccggatcgatgacaatatacgacgcgaaatagagcaccttctccagcaggcgcggcgacatattgagcagcagccccatgcggctgctcgttcccttgaagtaccagatatgcgaaaccggcgcggccagctcgatgtggcccatgcgctcgcggcgcaccttggaacgcgtgacctcgacgccgcagcgttcgcagaccttgcccttgtagcggatgcgcttgtagcggccgcaatagcattcccagtcctttgtcggtccaaagatcttttcgcagaacagcccttcacgctccggcttgagggtgcggtagttgatggtttccggcttcttaacctcgccccacgaccattcgcggacaagatccggcgacgccagtccgatttttatcgattcaaatacattaaattccaaaagcgaacccctcttttcttttgcaagcggcaatttcggtcgttctgctggttttagaagctgtcgtcattggcgatcccgtcaaggccaagctcctcaattgggtcgaagctttcctcaatgtcatcgtccgtcaggtcgacgtcgagcagatcgatatccgcgtcggcgtcggcgtccggatcgggatgctcgatatcaaagccatcctcaaactcggacgggacttcgacgccgtccatcagcgcatcgtcaactggggtcaaccccatattgtcgtcgtcgtcaaaggtctgcttgagatcgatctcattgttgtccttgtctagcacgcgcatatcaagcccgagtgattgaagctccttgatcaagaccttaaacgattcagggatgcccggctgcggtacgtttttgcccttgacgatcgattcaaacgtcttgacgcgtccgacaacatcgtcagacttgaccgtcagaatctcctgaagcgtataggccgctccatacgcttcgagcgcccagacctccatctcaccgaaacgctggccgccgaactgcgccttaccgccgagcggctgctgcgtaacaagcgaatacgggcctgtcgaacgcgcgtggatcttatcgtcgaccaggtgatgcagtttgagataatacatatagccaaccgtaaccggattgtcaaagagctcgccggtacggccgtcgtgcagccacgtcttgccgtcgcgggaaaggcccgcctgttccaagcagtcggcgatatctgtctcgtccgcgccgtcaaagaccggcgtcatgaccttccagccaagctccgccgccgcgcgcccgaggtggacctcaagcacctgtccgatgttcatacgcgacggaacgcccaggggattgagcacgatatcgagcggacggccgtcgggcagatacggcatatcctcctgcggcagcacgcgcgagacgacgcccttgttgccatggcggccggccatcttgtcgccgacgctgattttgcgcttctgcgcaatgtaacagcgcacaaccatattgacgcccggcgaaagctcgtcgcagttttcacgcgtaaagacctttacatcgacgatgattccatattcgccgtgcggcacgcgcagcgaggtgtcgcgcacctcgcgcgccttctcgccgaagatggcgcgcagcaggcgctcctcggcgttcagttccgtctcgcccttcggcgtgacctttccgacgaggatatcgccggcgcgcacctccgcgccgacgcggatgataccgcgttcgtcaagctcgcgcagcgcgtcgtcgccgacgttggggatatcgcgtgtgatctcctccggcccaagctttgtgtcgcgcgattcaatttcgtattcctcgatatggatcgaggtataaatatcatcttttacaaggcgctcgttgatcaaaacggcgtcctcgtagttgtagccctcccatgtcatgaagccgacgagcatgttgcgcccaaggctgatctcgccgcccgccgtcgacgggccgtcggcgatcacctgcccgacggaaatttcctcgccctttttgacaattgggcgctgattgatgcaggttccctggttggagcgcataaacttgatcaggtggtatgaatgactttcaccgcggctgtcgcggatcacaatctcgttggccgagacggactccacgacgcccgcgtgcttggaaacaaccgcaacgccggagtcgaccgctgatttatactccatgccggtcgccacaatcggcgcctccggcacaagcagcggcaccgcctggcgctgcatgttcgcgcccatcagcgcgcggttggcgtcgtcgttctccaaaaacggaatcatcgccgtcgcgacagatacaaccatcttcggcgaaacgtccatatagtcgaccttttcgcgttcacagaccattaccgcgtcgcggtaacggacgctgaccttttcattggcaaatttgccgtcctccgtcagcggctcgttggcctgcgccacgatatacatatcctcgatatcggccgtcatatactcgacctcgtcgaggacaacgcccgtcgccttgtcaacacggcggtacggcgcctcgacaaaaccgtattcattgatctttgcaaacgtcgccagatacgagatcaggccgatattcggaccttccggcgtctcgatcgggcacatacgtccataatggctgtaatgcacgtcgcgaacctcgaagcccgcgcggtcacgcgaaaggccgcccggtccgagcgcggaaagacggcgcttatgcgtcagttcggccagcgggttggtctgatccatgaactgcgacagcggagaggaaccgaaaaactccttgatcgacgcaacgaccggacggatgttgatgagcgcctgcggcgtcacaacgtccatgtcctgcgcctgcgtcgccatacgttcgcggatcacgcgctccatgcgcgaaaagccgatgcggaactggttctgaagcagctcgccgacggaacggatgcggcgattgcccagatggtcgatgtcgtcgaccgtgccgatgccatggccaagtccgcacaggtagttgatcgacgagaagatatcgtccttgatgatatgcttggggatcagctcgtcgcggcgggccgcgatggcctcgcgcagcgcgtcctcgccatcgcaggcgtcaagaatttcgcgcaggacagcgaagcggaccttttcgttaatgccgagcggggcgcagtcaaaaccgacaaagtccttgatatcaaccatgccgttggaaagcacgcgcatctcgcggtcgtccccgatcctgatataaaccgtgtcgacgccggccctgccgatgcgttcggccaattcacgcgtcaaaacggtatcggcgccggcgagcagctcgcccgtcagcggatcggcgacggggcgcgatgtggtgcgcccgagaatacgcggcgtgatagccagcttcttattgtatttatagcgtccgaccttggacagatcgtaacggcgcggatcgaaaaacagcgaatcaatgtggctctgcgcggaatcgaccgtcggcggctcaccggggcgcagcttgcggtagacctcgagcagcgcctcctccgtattggccgtgccgtccttttccagcgtggccatgatgcgctcgtcgtcgccgaaaaagtcgatgatcgattcgttggaactaaacccgagcgcgcgcacaaaggtcgtcaccggcagcttgcggtttttatcgatgcggacataaaatacatcgtttgaatccgtctcatattccagccatgcgccgcggttggggatgaccgtcgcggtgtaaagctccttgccgctcttgtcgtgggacgatccataatagacgcccggagagcgcacaagctgcgaaacaatgacgcgctccgcaccgttgatgataaaggtgccgctgtccgtcatcagaggaaaatcccccatgaaaatatcctgctcttttacctcgcccgtctccttgttgagcaggctggcacgcacgcgcagcggagcggcgtaggtcgcatcgcgttccttgcattcctcaatggtgtatttcggcttgtcgtcaaggtgataatcaatgaaatcgagcaccaggttgtcctgataatcggtaatcggcgatacgtccttgaacacctctttaagcccttcgtcaaggaaccactggtaggaattcttctgcacctcaatgaggttgggcatctgcaggacctcatcgatgtgggaaaaactcatacgcgttgtctttccctgcgttaccggcttcacgttcaccataggcttcgctcactccattcgtctgttttgcgcgaatcattttacttccccgcgcgcatccggacgcgcctgaaccgtccgcggcgggcatctatctcataatgttatgcaatttagacaggatttcccacaatttacccatctattttgcaaatcactattgccaaatttgtcgatctgtgttattataattgtgcatccttgcgcacctatctattttgatacagtatattagtttaccacactttgtcaaacctgtcaagaaaaatctgtggacaaattgtaacaaaatcccgcgctgtcggcgcgggatttttccacatttaaccatatttgcagcagttcgtcagatgccatcggagagttcatacaaatcatacgccctcgaaaagccggtacatcagcggcatcagcacaggtgccagtcccgtcagcaccacgccggatataacggccatcaacgcagtttcctcatcggtggcgcgcgcgatcgcgggcagcgtcgtgtccattgcggtcgctcctcccgccgcgaccgccgtataacgcccaaaatgacgcgccgcaaagggaataaccagaaatgccagcacttcatgcagcatatgcgtcaaaaacgcaatcgtcccgagctgggcgccgccaagctcccgcataatcaccgccgagatgctgtaaaaaccgaaccccgatccgatggccgcgctctcattgaccggcatcccaaacaacagccccaccaagaccgcgccggcgatggatgcgacggccaccccgaacggaatcacaaggatgcgcacattgtattcacgaatttttcggaataccgtcttgttcgttccgacctcgattccgaccgaaaaaatcagcactgccagcgcatacgacatcaccgtgtccatcacggcgatcacttcgggcggaaatacaaaaaggccgcacagcagcccgagcgcaaggcttccaagcgccgctatgatcatttttcaacgcccgcctttcccgcatccttcgggaatacgaggcgagacagtatgtacaccatcagcaccgaacaggacatcgttgccactgcaaacacagccgcgcgcaggcccgccgcgcgcaaatccgccagaaacgttggactgccggccatcgacgcgcccatcgaaaacaacgtcagggaaatgcccgctgtctgcaacaggctgttggccttgagccacttgagcggaaaaatcatcacgccgatcacgattccgatcaggaaaaaaacgatcagtgaaaacggtccgagaaaatcaaacaagcaaatccttccttttttaacaaatcaagcgcaggccgcgccggcacagccggcgcggcctgcgcttttttgcggcgttttgcaaaacgccgcgctctttcaatgcttactgcgcttcgatatacgctttaaacgcacggtaggtctggtatacgtccgccttggagacgacctcgaacggcgcgtgcatcgaaagcaccggcacgcccacgtcgacgacatccacatcaagcgccgcgacgtatttggcgaccgtcccgccgccgcctaaatcgacctttccaagctcgccggtttgccagacgacgcccgcgccgtccagcacgcggcgcacctgggccataaattcggcggaggcctggcttgtgccgtatttgccgccggaaccggtgtactgtgttacgacaacgccgtagttgacatacgaacagttacgcttttcaagcgtgtcgccgaatgtcggatcaaacgcggcgttcacatcggcggacagacaggtcgatttggagagtacctcgcggccggaaaggccctgctgcgcggccagactcttgataaagaatttcagatagctggagtttagccccgtgttgccgtcggagcctgtttcctccttatctgcaaagaccgtgaccgtcgtataagcgggagccttgacctccattgcagccatcagcgacgtgtaggcgcatacgcggtcatcatggccgtaagcgccgatcatcgagcggtcaaaaccgatgtcccgcgctttaaactgcggcacgacacacagctctgccgacaggaaatcggcctccacgatgccgtatttctcattgagcagccggatgatattaagcttgaccttttcgctcgccttgtcgtccttaaacgggcggcagccgaccagcacattcagctcctcgcccttcagcccgtccttgagaggccgtttcatctgttccgcggccaggtgcggcaaaaggtcggtcactgtgaacacagggtcgccgtcgtcctcgccaattgcgcaggtgattgtctcaccgtccttcttgacgatgacgccgtgcagcgccagcgggatcgcgccccactgatattttttgatgccgccgtaatagtgcgttttgaaaaacgcgatctgcgcctcctcatacagcgggttcggcttgaggtccagacgcggcgaatcgatgtggcttgcaatgatgcgcacaccgtcggccagcggccgtgtgccgaacgtcgtcaggatcagcgccttgccgcggttgttgtaataaacacggtcgcccggacggtatgcggccttcggatcaaagggcgcatagcccgcctcgcgcgctttttttacaatccaggataccgcttcacgttccattttacacgcgtcaagaaacgccttgtacggttcgcagaaatcctgcgcggcctgctcggacgcgtcgtcggccgtcatcccgatattctttctgttgagcagcagcttttcctgcaaaagctcgcccgctgatttttctttttccatcgatcgaatcctccctgtctgtccgcagccatccgctagaaatcgtacagcctgcggtaaatttccatagtctttttaaccttcgccacataagcgcgcgtatcgtcgaacgggattgtcgtgaccgtctcgccgtccggcgcatacgccgggtctgaaagccatcgcttcacactgccccatccggcatggtaagcgcacagcgcgttgtcaaccgaaccgaattcatccagcaggatgcgcagcatcgtcgtgccgtattcgatgtttatatccggatcaaagcacgcctccccctgcggggcctcaccgccgcccttgcgcatctgaatccagtcgaacgcatccggcatgagctgcatcagcccctgcgcgccgacatttgatttcgcgcgcggatcaaaaccgctttctgtgcgcacaacagcatagaccaatgccgggtccaaacccttttccgcgcacgcccgaccgatctgcgcttcgtatttcatcggatacgcgcggtgataatacgccgcaaacccaaagcgcgcagcagcgatcgcccctacggcaaccagcgcgagcagcgccagctcaaaagcgagccggagcgcgcgtctctgttttctgataaccgattcccccgatcattcgtcgccgccggtcagctcctcaaaatcgcccgcgccctgctcgggatcggcgggcggctgcaaaaccggttccccgccgcgcgcacggcgctcaagcttctccatcaggtccataaatgcaaagcgaagcgcgtcttcgtccccgttattttcaatcacataatcggcgcgtccggtataaaacgcgtcgttgttctgcgcgttgatacggcgcatggccgcctcctgcgtcatgtggtcgcgcgcaatgatgcgcctcgcgcgcgtttgttcatcggcgatcacagccaccacgcagtcgcagcgtttatcaagccccgattcgtacagcgtcggcgcgtccagcaggagcatccgctcgccccgcgcgcgcgcctgctctattttatgcgcaatcgcctcaatgatgtaaggatatgtcacttcattgaggcggcgcagctttttgcggtcggaaaaacagatctccgccagcttctcacggttgagtgtcgcatccggatgaatgacctccgtcgaaaacgccaacaccagatccatcaggcagcttttggaatgctccatcgtatcacgcgcgacagcgtcggcgttaatcaccgctacgctgcgttcggcaaacatgccgctgagcgtcgatttgcccgcgcccgtctggcccgtcaggccgataatcatggtctttgtgccgtccaccggcttttgcgcccccttttctcagaaaccaataatcaaacgatccacccgtcaggcaaaacatgccgcgggatatgccaaaataatccgtcaattgttgccaaaggcacggctttgacaagtcccgtttacacccaaagctcctcaaagcccgccgcccgcagcagccggttataaaccgcctgtccaacgccgcccgcgccgtccacacgcgcataaacgagcggcagccctgcacggtcgatctgccgcagcgcgtcgaacagcccgtgcgcctgcgaagcggcgtcgtcctgcgcgccgtagacgatgcacgggcacgacagcgcctgttcatctcccgccaggcagagcgcgccgaaccgccctttgcgcgacgccaaaaagttcgcgaacggcccgcgcgccgcatgtaccagtatgacgcgcgccttcggcgcgtaatgcttgtacttcatccctggcgacgcggcgcgcacgccgtccggcagccgctcaaagacgccgggccccagctcgatatccgcaagaacctgcctcgccatctccagcgtgaccgcgcccggccgcaaaatctgcggcggctgttcacagagcgtgagcaccgtcgactccagccccacctcgcacggcccgccgtccacaatcgcatcaacgcggccgtccagatcgtcgatacagtggcgcgcgcacgtcgggcttggcgaaccggacaggttcgccgacggcgcggccagcgggacgccggcgcgccggatcagcgcgcgcgctgccggatgcgccggcatacgcacggcaaccgtatccaggccgcccgtcgtcgcagacggcacaaggtcggatttctccaggatcaccgtcatcggacccggccagaaccggtccgccagcctgtacagcgcatccggaacagcctttacaagcggcggcagctcgtcgagcgacgcgatgtgcacaatgagcgggttgtcgcatgggcgccccttcgccgtgtaaatcgcggcggccgcggccgggtcaagcgcattggccgccagcccgtagacggtttccgtcgggatgacgacgagctttcccgcgcgcagcagcgcggcggcggcgtccagcgcggcctcgtcgcgcggcgtcccctctattttaaactgttttgtctgcaaaatcccatctccaatagaactttgggccaggcggaaagctttacgcttcctcggccgatttaagcttttcggcctggtcaaacgtcatcagcgcgtcaaacaattccgcaagatcgccgttgagcacggaatcgagcttatacagcgtcagcccgatccgatggtccgtcacgcggccctgcggataattataagtgcggatacgctcgctgcggtcgcccgtgccgacctgaaggcggcgctccgtagcgatcttgtcgttttgttcacgcaccttgatatccaacaggcgggcgcgcagcaccttgagcgcacgatccttatttttatactggctgcgttcatcctgacattcgacaaccatgccggtcggcagatgcgtcacccgaatggccgacgacgtcttgttgacatgctgaccgcctgcgccgctggaacggaacacgtcgatctgcaaatccctcgggtcaagctcaaactcgacttcctcggcctccggcagaaccgcgaccgtcaccgtcgacgtgtggatgcgcccctgcgtttccgtctccggcacacgctggacacgatgcacgccgctttcatatttcaggcgcgaataagcgccctcgcccgtgatggaaaaacagatctccttatagccgccaagctccgtctcgttggcgctgatcacctcgcactgccagccaagcccttcggcatacattgtgtacatccggtacagcacgccggcaaaaagcgccgcctcctcgccgcccgcgccgccgcggatttcaacaatgacgtttttatcatcgttgggatcgcgcggaagcagcagaattttcagttcctgcgccgtctgatcgaggacagcccggttttcgtcgagctgctcctgcgccagctcgcgcatctcgcggtcaacgccgctttcatcgagcacctcgcgcgcttcgtcgcacgcgtcctttgcagtgcggtaagcgcggtacttttcgacgatcggcgtcaggcggctgtattccttcatcagcgacgcgtactgctccggatcgccggtcacatccggttccatcaggcggcggctgatctcctcgtagcgcgccgcgacagaatcgagcttatcaaacatattgatttcctcctaagccgcttacagaaaatcctccgccggcagaacgcacgcttttacagcctgtccggcagcccggtttctacagacggcgctttgcaagctggctgcgatcaagttcctcaccgccgcgcatgacacgccggatatttttttccaccttcgcgcgcgcaaccataacctcacgcccgcagccgttgcagcggatgcgaaaatccattcccacacggccgacggtaaaccggcattccccgcatgggtgcggctttttcattataagaatatcaccgatctgaatatccatccgcgtccctcccgcctgatttcattaaaggcattctgtccgtttcaacaaacggcccttcctcaagatatccattcgatatcaatttattatacaaaatattggaccataacgcaaggatgccgccgcgaatattttgttcagaaaaatttttcacgaaacggatatttatggagatcaaagctcgccccgacgcagacacaaagggccggcggcccgccttttcttctcaagccgccttctgtctgtatttgcgcccgccgtaccgcttctatttgaaaaagcatgctcatatagatgatgtatgttgaaagaggaggggcgcgaaaatgccaacttataaaccggagggtatgctgattgataccgtccccaaccggcaggcgttcaaatcgatgacggcccttatggaggcgcaggcctccggccgcattctggaaagccgtgcaatcgtctgtgattccaaccataatttgattgttgatatgggcgcctggcgcggcatcatcccgcgcgacgaagctgctcttggtattgccgagggaacgacgcgcgacatcgcaatcatatcccgtgtcaataagcccgtctgctatcgtatcacgggctttgagcgcggcggcgaaggcattgttattccacagctttcgcggcgcgctgttcagcaggaatgtcaggatacctacatatcaaagcttgtgccgggcgatgtcatagacgcgaaggttacgcatttggaatcgtttggctgtttcgttgatatcggctgcggcctgccgtccctgatccccatcgacgcaatctccgtcagccgcatcgcacatccgcgcgaccggttcacacctgcgcaggatatcaaagccgtcgtcaaggcggtcgagccggatgggcgtgtttcgctcacacacaaggagctgcttggaacctggagcgaaaatgcggctctgttttctcccggcgaaactgttgcgggcatcgtccggtcgatcgaggactacggcgtatttgtagagcttgcgccgaacctcgccggactggcggagccgcgcgagggcgtcacagtcggccagcacgcgagcgtctacatcaagagcctgatcccggaaaaaatgaaggcaaagctgattattgtcgacgccttcgacgccggatggcgcgccgccccgacgccttatttcattacagaaggccatatcagccgttggcagtactctccagcctgttccgaccggctgatcgaaacggtattcgatccagcataaaaaagcacaggggcgcgggccgcccctgtgctttttttattactttttccacacaatacgtcccacgcatccggccgtgggatacgccgtcctctttttcaaaaagccggaaattatctgccatagctgctgatttcgatagaattgccatccgggtcacgcagataaaacgactgcatcgcgccgcgcagaccgttgcgcggcacgagcgaatcggagacatcaagcccctgcttttcgaaataatcacgcagcatccgcagatcgtcgatattgccgtccaactcgaagcataggtccgtactgcctggctgcatattgtcagcgtgcggataaacgccgtcgccgcgccggtaaaggttgatgcgcacgtcgccggcggtcagctcataccgaccctgcgcgtcccggatggaaaacccaagcatcctgtaaaacttgaggcattcatccacaacgtccgtcgtcatcactacgtgatcaatcttcgaaatacgcatcgtaacgtccccttcctgtccgattttcagtccgcgtcaggcatccgtttcacgctccagcttttcacggtacgcgcgcgcggcctgttcggtcctgttgtctccaaaggtgtagtacgtccgcccgagcagcgtgtccggcagatattgctgccggacaaaatggcccgggaaatcgtgcggatacttgtaaaactggcctggccgcgtgacatccgcgccgtcataatgcttgttttgcagacagcgcggaatcggacctgccagcccggcgcgcacatcggcaagcgcggcgtcaatacctgaataggccgaattggatttcggcgcggtagccagcagcacggccgcctgcgccaatgggatgcgcgcctccggcagaccgagctgcaaggccgaatcgacgcaggctttcacgattaccgctgccatcggataggccaggccgatatcctcgctggcaatcacgagcagacggcggcacggagaaagcaggtcgccggcctccaaaagccgcgctagataatgcagagccgcattctcatccgatccgcgaatagacttttgcagcgcggaaaggatatcataatgctcatccccgtcacggtcgtagcgcatggcgcttttctgcgccacctgccgtgcttcctccagtgtgaccgtctgattcgcaccagccgcgagcgcaagcagttcaacagcattaaccgccttgcgcacgtcgccgccgcacgcggacgcaatatattcgtacacgctgtcctcaacttcaaggcggcggcccgccgcctcgccggcagcctcaaacgcacgctgcacagcgcgctgcacagcctgaggctgcaccggcttgaattcaaacactgtgctgcgcgacagcaccgcgttatatacataaaagtacgggttttccgtcgtcgaagcaatcagcgtgatcgagccgttttcaataaattccagaagcgtctgctgctgctttttattgagatactggatctcgtcgagatataaaatcacgccgccgatgccgtcgattgtattcgtctcgccgaccacatcgcggatatcggatgtggaggcagttgtcccgtttagcttgcagagcttctttccagcacgtttggcgatgatcgacgcgacagtcgtcttgccaacgccggacgggccgtaaaaaatcaaattcgggatatttcccgactcaaccatgcggcgcagcaccttgtcccggccgagcagatgctcctgcccgaccacgtcgtcgagcgtctgcggccggatgcggtccgcgagcggcgctgccataagatcacctcgattttattcgtacagcggatattttgcacagagcgcctcaacacccgcccggatctgatcggccttcgactcgaaatcggtcgccgccagaaagataaattctgcgatccggtccatgtcctcctctacaaagccgcggcttgtgacggcgggcgtgccgatacgcacgccgcttgtaacaaacggactctgcggatcgtcggggatcgcgttcttgttgacggtgatatacacctcatcgagcttcttttcaagctccttgccggtgacgccgaaattgcgcagatcaagcagcacaagatggttgtcgctgccgcctgaaacgagcttaaagccgcgctgcgtcaacccctttgctagcgcctggcagttttggataatctgatgctgatacgccttgaaggccggctgcagcgcctcgcccagacaaacagccttagcggcgatgatgtgctcaagcgggccgccctgcgtacccgggaaaatagccttgttaatcttcggagcaagctcctccgtacacaaaatcatgccgccgcgcgggccgcgcagcgtcttgtgcgtggtcgtcgtcacaacgtccgcatacgggaccggatttggatgttcgccggcagcgaccaggccggcgatgtgcgccatatcgaccatgaaatatgcgccaacttcctttgcgattgcggacagcttctcaaagtcaatcacgcgcggatacgccgacgcgccggcaaccagcagcttcggcctgcattcgagcgcgatcgagcgcactttgtcataatcgatcacctgtgtgacagaatcgacgccgtaaggaacaaatttatagtacttaccggacatattgaccggggatccgtgtgtcagatggccgccgtcggccaggctcatgcccagaacggtgtcgcccggctcgagcagcgcaaaatagacggccagattcgcctgcgcgccggaatgcggctgcacgttggcgtgcgccgcgccgaacaattttttggcgcgctctatcgcgatattctcaacctgatcgacaaattcacagccgccgtaatagcgcttgcccggatagccttccgcatatttgttggtaagcacggaacccatcgctgccaacaccgccgggctgacgatattttccgatgcgatcagttcaatatttctgcgctggcgcgcaagctcccgctgcatggccgccccgacctccgggtcactttccgatacgaatccaatcgtatcaagcatgtcattgaacatagtaacgatccctccattatcaaaatgaccatccccgccggcagcgggaacagcgccggacgctttgcccgccgcatccgcggcagcagccgtccgaaaaggtctgcggctttcccatccgatctaaaaaccgcttgcgtgttttcagtatagcatagattgagcctgtcacacaagcaccttgcaaaaaaggccggtctttctttttcccggcggatatgttaaactggcagcagtatcccaacaaaggagagattgccttgtccatgttcaaccggccgacgccgcccacctggaggattttactctatacggcgctttccatcggcgtgcttttattactcgggcgtcttgcgccgtatatcctggcttaaccgctgttcgaaaaaacagccggcctgaaaatgcataaaggggcgcggcataaaatatgccgcgcccctttatataaattaggagaaaaaaatgaaaagcagatttgtgtttgtttgaaaagccgggacatccaaagcccacgccttcaaaacatgaatcaggcggttttttcgacgcctgaggactcctccgcggagaagcgtacccgcgttgtacgggagctgcggtatttgcggctggccttgccgtatgcgatcatgccgctgacaaaggccacgcccgcgccaagcagaaccgaagcaaacagcttctcggcaaatttatttacgaacaggtaaaccgcgacatcgcgcagccagcgaagcatcccaacgtcgcgcgaaatttcgatcataccgcccgcgagaaatgataaagcgatgaatgcggcggcagccacaattacgcctgtacgaaacgtatgattttcattttttctgttcagcatggctgtcgcctcctcaaaaagttacaatctgtaacttttataataatttctacaaacaattttacgttttgtattttccttatctatactataccacagaaaatcagaaaatcaagaggaaagcgcgaaatttattaaaatttttttcatatttgtaactggtttgtaattagtttgtttctattttgtaatctctcaattcaagcagccttcttttgttaccattctgtcatgtttcaacgcattttatgcccgcaaaggcaaaaaaagaaccatccggacaaatccggcgctgccttaccgcggttcttgccgatttttgacgcgggtcttgacggtcccgtcgatctttcctacaataaaaaacatctcatgtcgccggacaggctgttaagtcgcctgcatattttattaaagcgcccatctcagggcaatcagccaaaacgaggtgtcacatgtcagaaaatataccgctgcgaatcattgcgcatatccacagcgatttccccaccaaatttggtatcccgcgtcaaagcggcctgattcatgagctgaaggcagccgttgtctttgaacctgaataccgcaatccggacgcgttgagagggctggaaggatatacccatatctggctgatctggcagttttcagaaaccgcgcgtcagggatggtcgcccaccgtccggccgccgcgtcttggcgggaacacgcgcatgggcgtctttgcaagccgttccccgtttcggccaaatcccgtcggcctttcatccgtacgccttgaacgcattgagctgcaaagccccttcggtcccattcttcatgtggcgggcgctgatttgatggacaacacccccatctatgatatcaagccgtatctgccctatgtcgattcccatcccgatgccgccggcggttttgccctgcaatcgcacgagggctttctgcaggtaaacgtcccgtccgggcttttggagcgcatcccgcccgatcgccgcgacgctctgcttgccgttctggcgcaggatccgcgtccggcctatcaaaacacgcccgaccgcgtttatggaatggaatacgccggttttgaaatccggttcaccgtaagcgggcatacgcttacggtttgtgaaatcattgccgaatgatgaaaaacgggctgcctgttttatgcaggcagcccgtttttgtaccaaaaacgcatgcgcatttttgtgtatcaaacgccgggcaaaagcgccctgaaaatccggcaacactcaatacgtcggattttcaacctcgatcttatccacctcgcgatagggagcgagagtggatatcatcttgaccggagcgtcgtaggcattgcggcagtaatggacttcttccggctcaatgtggattaaatcgccggcggaaagcgtgtggacaaccccgtcgacgacaatatcgatcttgccttccaaaataaagaaatcctcctccatcacattatgataatgggcgcggaaatcctgaccaggcataaactgcacgaccgcaaaattcatccgtgggcctttcatcagatacttgggaccgctgtccccaaaacggtactcgcggtcattttcattgataataaacatggttgtctctcctttttctgtttgtattctcaggaacgtccatccagccgatactttgcacatggaagacgggatatttcttccacgcctgcggattcagtacagccccggggcaatccacatatttttggtcagcttgcggtcgcacagctccaactgcgcgcgataaacctcccgccatggttcgtacatcttctcataaatctcatgattgccggggtccggctggaaggtgcggtctattttaacgcagcggcgcgccccttcggtaatcgacgggtaaatccccacgccataacctgcaaggatcgcggcgccgagcgcggtcgcttctttgacgaccggcgtcaccacgggtttgcctgtcacatccgccaaaatctggcaccacagcggactctttgaggccccgccggcaaagatcagccggtccggttcgccgccgaccgcatctttaaccagttggatgtggcctttcaccagcatcgccgtgttttcaagaattgcgcggtaaaacgtatagcggttgaatttttccggatccagttcgaagttcgtaaacgtgggggaggcatgtttccagttgataaaattcatcacatcgctgaaacagcacatcatgccatagctgcccgtgggaatcttggcggcctgttcgtccatcagcgcataggggtccctgccggtcctttccccctcctgcttctccagctggcagaagccgtcgcgaaaccaccgcataacaagaccgggtttaaaggccagcgcttcatactgccacaatcctggaactgcatggcagttgacgcgcacacgggcataagggtcggttctgccgctttctgtattaaactcatactgccagaagcttcctccgaacaccacggcctgcccggggtcagaggcacccacgccgattgtcccaagctggcagtcgccgccgccgaccacgaccggcgtccctggcgcaagacccgtctggagcgcgccggactcatttacaacgcccgccaccgttccgctctcaagcacccgcgggaagatgtcgccgcgcaggccgcatctttgggcgatcgaagggtcccaattgcggctctgcaagtcgaacaggcctgttgtggagccgttgctcggttccacggcaagcacgcctgtaagcttatagatcagccagtcgttgaacatccccaccacagcggtcttttcataaatttccggcatcttgtccttgacccacaggatacggggaatcgcgttgagcgcgtagctctggccggactgttggtacagctgcttttccagctccggatttgtactgatcagcctgcccacctcgtcggtgcttcgcgcatccacattggcgcaggcccatatctcgtttccgtcctgatcgtaaagcaggattccctctcgcatacatgtggtggaaaccgcagcgatttcgtccggggcaacgcctgtttcatgcaggacatcccggatgcacccgctggcaagctcccagttatgtacccagtcaaaatccatgctgccgggatagcgcgggtcctcgcggtgcgtccactcctgctgtgaacatcctatctgatttccgtccagatcaaaaaccacagcgcggacgctgccggtccctgcatctaccgccatcaggtatttcgccattgtggaaccaactccttttttaaaatattatctttcataaatcaaacggcgcccgaaggcatcacggcgtctcggaggtcttcaacagcatggcggccgtttcctcgtcggtaatcaggatatccaaatatttgcccctgagcgccgcgtggatggcctccgccttgtgccgtccacccgctacgccgatgacattgttcatctttttcagctcctcgagcggagtgctcaaaagcctgttatccaacccgctttcaaccgggtttccatccttatcgataaagtggctgagcaggtcgcccaccgcgcccttcatcgtcagcagcagaacatccgcctgtgtgagaatgctgtttttgatgatggtggcgtcttcgctcatactgccgattcccaccaccgtcatggccgcctccctactcatctgttgaatgcgctgcacagagtcctccttgcggatctcctccaccatttcgggattgcttaaaaaaagtggagacgggatcagatgcagcctcgcgttaaaaatactggactgggcattgggcaggtaatggttcaccccgcctgtcagcgcgaccacattgatcggtgtttccgccctgcgcgccaaatggttcagaacccgactcaaagtatcaccgtatcccatgttgatgaaataatttttgtccagccggtcgctgatatagatggcggcggcctgcgcaaggctctcgttgagatcgccgacttgtccgttgaccgggacgacccatacgtcctgaaggccgaaacgggtaatcagttccttttccacctgcattctccggtcgctgtcctgccggatatggaagctgatgacgccgtcctgacgcgccttttccaaaagccggatcacccgtaccctgctgatcttcaataatttcgatatattctgctgggtatagttttccatataataataccaggccgctttaatcatcaaggtttcctcataggaaaaatcgccgttcatattgacctcccctcgcccacgtcaaacgaagcgccaaaagcttaacaaaaattcgcttccgataattttgttccacgaaaatagtatagcattcttaattttagatgtcaatccgaagcctattcaaagcacctttagcaaaaatttgtgataacgcacaaatcccaaaattaatccgcaaacaatgtacacaaaaaattaaaaaaataaagaaatttaggataaaatatttttattatctttaaaatttttgttaaaaatattatgaaattaaaaaatatatgaaaaaagcacagttgacaaccccaccaaaaaatattattctttagataaacaaaagacatggctattaacttttatgtattcctgagggggtaatgatttgacaaagccaacttcacctgacggggataaactgttgtcggtccgaaacatctacaaatcgtttgcctacaacgccgtgctcaaaggaatcagcatggacttggacagaggcgaggtcttggctctgatcggcggcaacggcgccggcaaaagcaccctgatgaaaattatcatgggtatctattcgcacgacagcggtgagatcgtggtgggcggcagggaaatgaccgtgggaaagccctcggaagcgctcgccaacggtgtatacatggtgccgcaggagcctctgctttttcccaatatgaccgtggaggaaaatatcctgattggtttcaaccggccgcagcgggagctgcacaaggagctggtggaaacaatggagagcatcggctggaggctggagcttgatcgaaaggccagcacgctttccattgcggagcagcagcttgtcgaattgcttcggggcctgctgcgtcacgcgcaggtgctcattctggacgaacccaccagcgcgctcacctttaaggaggttgaaagcctttttggctgcgtgcaggatctcaagagcaagggtatcggcattatctacatcacccaccgtctcaacgaggtctttgagattgcgaccaccgtggcgatcatgcgcgacggcgtcgtaaccctctccggccccgtaagcgactttacaaaagacgacctggttaaaggactgcttcctttggacatggcggtccaaaaggtcgacacaggcagctcggttgattactccaagccacctgtgctggagctttcgcatttcagtggatatgggtttaccgatatctctctgaaggtctatccaggcgaaattctcggcgtggccggggtcgtcggcgccggccgcaccgaaatggcgatgaccattttcggcaaggacaaggtgctgggcggcaaggtgctgttggacggaaaggatatcaccggacttaaaaccaaggacgttatgaaggcgggactcaattatgtctcagaggaccggcacgccgatggtctgtttaaaataagctctgtggctgaaaatacgaccagcgcgattctgggcagcctgcggatggggcgtttctttctcaaccgcaaagaggaataccgggtgacgcagcaatatgtggacgatttccgtatcaaggtcaccgggcaggatcagcttgtcggaagcctttcaggcggcaaccagcaaaaagtggtcatcggccgaagcctttccagcaatcccaaactggtcattttggatgaaccgacccgcggcatcgacgccgcggcccgcgcggatgtgtacaacattattcagcagttgagcaaaaaaggtgtctctgttctgctgatttcctctgatatggaagaaatcatagaattgagcgaccgggctgtcgcgatctatcagggccggctcaatggaaagttttccaaagaggagattacacaggataacctgaccagcgcgtcctttggtctgtccgggaaggaggcaaatgtatgaatctgctgaaaaaggctttaaaggcgagagaggcaacgagcgcattattcctggtggctttatttgtgattgtcagcctgctcaatccctcgtttgcttcctcggaaaatatcgccgctgtgttcaactccgcggtggtttatatcctgatcgcggttggcatggcctttgcgatcatcgtcggtgaaattgatgtttccgtgggttcctgccttggctttgtagccacagttgtgggcagcctgctgcgggacggctgcaactggccgctcgctttcgcggtgggaattctgatcggcgctgcggtggggctgatcaacggatggggcgtcgcagtgatgggagttccatccctgatctttactttgggcgtcaacggtgttctgcgcggcgccatgtatatttactcaggcggcgcctgggtggaaaatctacccaaagcgtttaaggatttttcctcggcgactttggctggacggctcaccgtctatttttgctgcgctttcctgttggtcgtcgctgtccatctgcttttgacgcgcaccaaaaaggggcgttacttcaccgccgtaggcgacaacgccggcggcgcgacccttgtgggtatttctcccgtgcgtaccaaggtgatcgcctatgtcatctgcggcatcatggcggcgattgcgggaattatcttttgcagccgcatcggatttgttacgtctacaagtggaaacggatatgagatgaaagccgtagcggcctgtgtgctgggcggcatcagcctgaccggcggcgttggcagcgtgcttggcgcggcaatcggcgcggtcatcatgagttccatcagctatctgctggtattcatgggattttcctcaaattatgacaatgccattactggcgtcatcctgatttcgatcgttgtattcgacgcggtcatccagcatcgcgcctcagtccggagccgtcatcagcggctggcagccagaaccggcctcaaggaaggagggcttgcagaatgagcaaaatgaaaagcggtcattccaaaggccttaaatcgttgttgcgtaactggaactcctttctgctgctgttccttgttttggaatttgtcatttttggcgcggccaattccaagttcctgcggataccgctgctgctctcaagcgtcaatgacttcatcgcgatctgtttgatcagcctgtttgtcacattcgttatgattaccggcggcatcgatattcaggcgggcgcgatcgtcggcctgacctcgatcaccatcggtgtggcatggcaggactttggcctgaatatctgggcggctgtactggtggccattgccgccgcggctctctgcggcgcgctttccggctttttcatcgcctattgccgcgtacaggccatggtggtcacgttgggcggtagtttcctgtatgccggtgtggcgctgctgatctcgacgctcagctccaccgagagctatcagggtatcagcgggttccccgacagcttcaaggctttaactaagttcaaattgtttggcgtaatcccctcgcagcttctgatcttcgcagccatgacattgatcgcctatctgctgcttcataaaagcaaatatgggcgcaaggtgttcctggtgggtgtgaatcagaacgcggcggagttttccggtatcaattccagacttatcattctgtccacatacgtactcagcgccatcagtgcggcggtagccggtatcgtgctgacttcctatctcggtactgcaaagagcgatttgggcagtaccctgaccatgaacatcatcaccgcctgcgtgctgggcggcacgctctccaccggcggtaagggcagcgccatcggtacggctctggccgcgctcatcatcggtatcctccgtttcggtctgcctctgtgcttcggggtgagcacgcaatacctggacattcccatcggggttctgctgattgtcgtggtcgttggacgcgccatggcgcagcagccaaaggtcatcagctttatggcccggttaaaacagaattttccaggcgtcaggcagggagcaaagtgagtttgggtaattagagaagccgcatcccccttcttctctaatatataaaattcaggaggtaagtaaacatgaaaaagaccatagcatttcttgcggctgtttcgatggtaatgtctctggctgcatgcggcggaagcgctccggcagcgaattccgaggcggccgccagcccggcggccgatgctggaaccgccagtgccgccgccccggaggcaagcagcgccgcgggggcaacctctgccactgaaggcgccgctgtctcggttgagggaaagaccgtcgcgtttatcccgaagctgaccggcaacgctttctttgaggccgcgaacgaaggcgcgcagaagtatgccgccgactggggaatcacggttgattacaccggcagcgccaatgccgcagtagcggatcaggtgcaggtcatcaacaccgcagttgcttccggcgctgatgccatctgcatctccacggtcgacgcagccggcgtttccgacgccctgaaggccgctactgaggccggcgtttcggtcgtcacctgggactccgatgcacagcctgccgaccgcactctgatggtttctcagggtacccccgaggttctgggccgtatgctcatcgatatggcctgcgcgggtctggagaaacgtggtatcgacccgaagaacgacgaggttacttattgctggcactattcccaggcgactgttaccgaccagaacagctggcaggtagccggcgaggcaatcattaaagaagaatatcccaactggaccaacgtagcccccgacaactattattccgagcaggacgctgagaaagcgattaccatcggcgaggccgttctggctgcacatcctgacatcgacgtcatcatctgcaacgactccacagctctgcccggacagctccaggccgccgagaacaagggctacaatcaggacaacatcaccatcaccggttttgccagcccgaatgcgatcaaggaatattgcagcaacggcaccctttacaattggggcctgtgggactgcggcgttcagggcgccatgggctgttatctggccgcttacatggcagcgggcaatactgttaaggttggcgatgtgatcagcatccccggaatcggcgactgtgaagttctcgccaatgaaagcatcgcagaaggcgccgccaccgccgagacgaacaacggcgtcgtgctccttcctgaaaccagcgtttataccgctgagaacatgaacgactacaacttctgatttttctttctccacaaacaggcgcgcggagcaccccttcggggctgtgctccgcccctgtgaggttgtcgcgggcgcggcagtctcacaggggcggagcaaaaatgctttgccgggcggatttatttattttgtcaaattcataaaatctaaaggaggacatatattatggcagatctggaaggtgtaaaagtcgcaaaaacataccatacggacataccctttgccaaccaaaacggtttttacttaaagggctgcaacagcttggattggggcatgaagcgccatatggccaatattttcaatccaaagagcggcaacaccgtaatgttcgcatttgaccacggatattttatggggagcacgtcgggcctggagcgtctggacctgcttcttcccaagctggcgccctatgtggactgcttcatgggcacacgcggcgcaatccgcacatgcgtcccccccgagctgaccaatgcgatcgctctgcgcgtatcctccggctccagcatgcttcaggatgatctgagctttgaaacggtagccgtggacatcgaggacgctatccgcatgaattccgattgtatggccgttcagaccttcatcggggcggacggccagctctccagcatcgataatctgagccaggtcgtcaatgccggtatgcgctacagcatccccacgctcggcgtctgcgccgtgggcaaaaacatggaacgtaccgaccgcttcttcaaactggcaacacgcatcatcgcggagatgggcgtccagattgtcaaaacctacaactgtgaaaactttgaggaagtcgtggccgcatgtcctgtcccgattgtggtcgcgggcggcaaaaagctttcggaacccgacgcgctcaatctcgcatacgatgttatgcgcaagggcgcgcacggcgtcgatatgggccgcaatatcttccagagcacacatcctgtcgaaatggcgcaggcagtcggcaaaattgtccacgagggctataccgacaaacaggcgtatgagttttatcaggatatgatcaacggctaagaggaaaattatggtggacagagaaactggctgcggttttgtgctgccggaatcatctttgtccaccttctttttttgtgaggagggaatctgctttgttcctgcgcgtactggaaatggtactcccggtcttaattttgcttctgctgggctgctggtgccgcttcaggcagatttttgatcatgggggcctgatgggtctgaaatctgtcatcagcaatatcgcattgccggttgtgctgttcaacgctttttttacagcgaaatacagtttgaccgtcgccatgctgtttgtagcggtgtatattggtttctgcctgacgatggccgcgggcttcggactgcgccggcttgccgcgccatatggaaaatttatgccctttctgttgtccggcgccgagggcggtatgttgggatacgccctttacgggctgctgaccggcgaacagtccggttttgcggccgtagatcttggacagaccgtctttgcctataccgcttttctggcggtgttgaaatcgaccgacggccagacattgtccgcaaggatgatgctgcgcaacatggttacgaaccgatgctttgtgggaatgctgctgggtatcatccttggggtggccggtttgggaacctttgtcgctggcagtccggtcagcggtattgtctttggaagtatcagtgcaatcactgcgcctaccagcgcgttggtgctccttgtggtgggatatgagctgaatctgaaaaagagccttttgaagccggtggcgatcactgtactcagccgtctgattttgatgggaattcttcttgtaatgatcagcatgctgatcttcagcattgttccctatgacaaaaacctgcatctggccttaatggtgctttacgctttgcctgcccctttcatcattcccctattttcggatgttggaaaggatggcgaatatatctccaccacgctctctctgcataccttgtgcacgatgctgctgtttgtggcaatcgcagcctatgcggttgcctgacggcgcatactgaaaaaaggacttggaacctgtcggttccaagtccttttttgctcatatcaaccatttttccgggccgacagcgccgccatcatagccagcgcaaaaagtatttggaatgccggatacagcgccatgcctccaaagtcggcaacccacccaaacgcaatcggtatcagcagtgtggcaatttacgaaccccttcagcatatcggcattttggggcatcagacttgtacagagaagaccaaagcgtctcccttgaagcctccttttcgtttcaccttatcggcccgcaaacgatcggcacagagccggatagacaatcagcgccaacatgcctccgatcattgcagtcacaaactgcggccaagagaacatcactgacaacatctgtacttgctttggcgggatatccggcaatattcccaggagcgtgggaaccgtcagccacaatactgcacactttactgccgcgccgagcacaacgcctgcggcacgtattcctataccattgaacctcgtaaaaaagaaccaagccgctgccgcgatcacagcattgcctaatgcaatcgcaggcacaatgaaaggtaccggcgtcatgccaagcaaagccgccagaatcgaggaaatcacaccgcacgttacacccgaccagacgcctgcgcttgccgccgccagaatcagtacaagattgaccagggacccggttatcagttgattaaggctgaaaggtccagcaattaccgccccagcaggtaataatttaccgatcatctgggccaacagtaccagcgcagtacataaggctgtacgggtaatccatttaattttataatctgtttttgccatggcggcacctccaaattccgattacaattatacctcatcggtgtaatttgtcaagggttggctcccatgacagaagcgatcgtaaaatatacaatatcaagaaaaagcggttttgttttaaaaaaccgctttttcttgattcatgaggctgccgaccggatttaaaacggctgtcccagattcatctggtatccgggtatagcccagccgctctaaagcagcgagcgcccgagctacgtggttgacacccaataccagcttcctttgcggacccattcccaaagtatcctccagacacaccggaacaggcgtttcttctgctatgggccgggtcaacttcaggagctgaaactgatgaaccatttttactgcttgacggcacaggtccgtaacctggtcaaatctgttctgctctaccagatgccccggacaaatccagcttccaccgcaagccagcacattgggcaagcgcagatattgcgccagattttccagacgaatccctcccgtcggcataaaacgcacgccctgatacggagacgccagagctcgcagcatagacgctccacctgacggctctgcagggaaaaacttgacctcagtcaggccaagctccagagcggcttccagctcggtaggggtggaaatgccgggaaagacgggaatctcccgctcctggcaccatgttactaccgaccgattcaagccgggactcacaataaaccgcgcaccggcatctacgacttttctcgccatgtccacgctgtgtacagtccccggcgcccaccagaacgtccggtacctggtacgccgcttgacgaatggcttccagagcggtgtttgttcgcaatgtgatctccatgctgttcaggccccctgcccggatcgcccgggccagagcagcacctttctccgcctgcttcaagacaacaacagggaccaggccgctctcaaagaaggcctgcgttactaaattaggcactttgccgcctccagtccttttggccggccataaacgcatccagctccccccggctgagcaggccatcgttgtccccacagctcataacctggatcgcgcccaccgcacacccgcgccggaccgcctggctgaacgtctgcccctctctcagcgcggagagcacgcctgccgcgaagccgtcacccgcgcccacggtgtccactacgcgttcaacccggaatccgtccacatatccggacgctccatcttcgcaggcgtaataagcgcctcttgttccgagtttgaccaccacggcctttgtaccacggctgatgtagtgcgcagcaattttctccggggcttccgcgccgatcaggagcgacgcctccttaattccagacagaaagaggtctgaccggtaggcgatcgagttgaggtacgccgccatctccgcctgagacggccacagttagggccgaaggtttggatcgaaagaaaagaaacacccggcttttctggatttctcgttcagtacctcggaggcagcgcgagcagatgcggaaagggcaggggtgatgcctgtgagatggatcatatcaaacttggaaaaatccagcgtctccacatcctccgccgccagggtggacgccgcactgtttctgcggaaataacagatcgtgggagctcccgttgtgaccttggatttgaacatgaacccggtcatgtgagtgtcggagcaaaggatctcatccgtagagatcccaaatatctttattatattttattttttatttatcggtttcatattgaaaaatactgaaattgtaagatatatacccattctgaaggctcccatacaaaattcaatgaactgctggcatacctctaagtggaagaatacattggagatgatccatgaagcacaacaacagggcaagcttttgggtgatgcacggcgtgaacctgctgtgcatggcgatgaagggcggagtggggtacacgacatgttcaaacaaaataaaaccgcccttttcaaacgaaaagaacggttattgtggagctgctaaccagatttgaactggtgacctcgtccttaccaaggacgcgctctaccacctgagccatagcagcatatacagacatccgtctgtaggaaaaattggcaggggcagaaggattcgaaccctcggcacgtggttttggagaccactgctctaccagctgagctatacccctattttgcccacgtaaagtatttacatactataaaaatccctgtggtgggccatcagggactcgaaccccggaccaaccggttatgagccggtggctctgaccaactgagctaatggcccgaaataagaaacatgccgccgcctatgcggcggcatgtttggctccccaagttggactcgaaccaacgaccctgcggttaacagccgcatgctctaccggctgagctattgaggaattataccatgccgcttcgcggacatggtataataaccgcagagcggttattataccaatcttatggccaaggcgatacgtgggcgcggcccgcttacaccccgatggccaattataatattattctttctgaaaaaatgaaagagaggtgcatgcatgaggaaaaacttaaaactgaaaattaatgaggcgctctcctccgtcctcccaatcacattgattgttcttcttctgagctttacgctgacacccatgccgaccggcacgctgatgctgttcatttttggcgctgcgctgctgatcattggaatgggctttttctcactcggcgcggatatcgccatgatgccgatgggcgatggtatgggcagaaagcttgtcggtcacaatcggacggcgctcgccgtaattgtctgctttctgatcggcgcagttgtcacaatcgcagagccggatttgcaggttctcgcgcggcaggtgcccgccgtacccgatatgattatcatcctgacggtcgccgcgggcgtcggcgtatttttgtctgtggcgatgctgcgcaccaagatccggattcagttacgcaccatgctgctgattctttatctggctgtttttgcactggctatatttgtcccgcgcgcctttttagcggttgcgttcgattcgggcggcgttaccaccggtccaatcaccgtaccgtttattatggcgcttggcatcggtatggccggtgcgagcggcaatgatgaaaacaactttggtatggttgcgctgtgcagcattgggcctattctcgcagttatgattttagggctttgctacagttccacctcggtcaactatacccctttttcagttccgactgtttttacgtcgcaggatgtcggcaagcagtttgccgccggctttcccacctatatccgcgaggtcatactcggcctgctgcctatccttgttctgttcgcaattttccagtttgccgcgctgcgtctgcggcggcacgcaattgttaaaatcctgatcggcatgtcctatacgtttatcggacttgtactgtttttgaccggcgcgaacgttggatttatgcctgccggttattttatcggcggcgagatggccagcctgccgcaaaaatggatattgataccgctgggaatgatcgtcggttattttattgttacggctgaaccggccgtccatgttctcaacaaacaggtcgaagaaaccaccagcggcgcgatttcgcagcatgtgatgcgtctgagcctttctatcggcgtggcggtttccatcggtctttcaatggtgcgtgttctcaccggaatttccatcctttggtttcttgtccccggttatgcgcttgcgctcggcctgatgttcgttgtccccaaaatgtttacggcgattgcgttcgactcgggcggcgtcgcaagcggtcccatgacggctacctttctgctcccgtttgcgatgggcgcgtgtgaatcgctcggcggtgatgttttgatggatgcattcggcattgtggccatggtcgcaatgacgccgctgattacaatccagattgtcggacttgactacaagcgcaggcttagaaaggctgaagccgccgccatttcagcaattgatgatgaggtcatcgactataccgacgcggccaatgcacaagcatcgcaggaggatttataaatggaacagcatctgatcaagcttctgattacgattgtcgaccgaggaaagggcgccaaagctgctgcgctttatcggtctgagcatctctattttaattatatctgcctgggacttggcacagccaacagcgaaatcctggactattttgggttaagcgaaacgcaaaaggacgttgtttttacgcctgcgccggccgtcaaactgcacagcgtcatgaaaaaggccggcgaacacttccggatcatgcatcctggaatgggaattttatgtgctctgccactgtccggcgtcagcgggcatattcccaagtcaacctgcaggccggaattcctgtcaactgaaaacggagggaaagaagtggaagcaagcgttcagtatgatttgatcttaacaatcgtaaaccacggatgtacagacacggtcatgcgtgccgcacgcgctgccggcgcaggcggcggcaccgtgcttcatgcacgcgaggtcggagaggaggacattaaaaacctccttggaatcaccattgagccggaacgggagatcgttatgatcctttccccccgtgcgcaaaaacaggcgattatgcaggcagtgaacaaagctgccggtttggcaacaaactgccgcggcgttcttttctccctgccagtcgacgcgattatggggctgcataacgcagaaacagacgtgtaaaaattgctttcgcgcggtggtttgtacatctgcccgcagagagccggccgatatatgcagcgcagaagggacccaggtcaaaaggcctaggtcccttctgcgctttttgtatggacagtgcgcaagctgcgcctaatacttggatgttgccctggctgtcgtctgcccaactttttgttttgatgttttttcttgacagtttactttttacgtcatataatgacaagtaagttagttatgactaaccaaatattctgttcgggtcccgtttgaaaatagaacgattaaatagaatccattttctacgccccgttaagcgaggaactttgatgtttgaagcaatgcttgaacagctctgtaggcagcgcccgcttcctgggcaatttcagtggatatcctccatggagggcgtacgggtctgtgattttacctgcgcgctgcctgcaaggctaatatcggagaatgaaaccgccaggcattatgaagcgttgttctgccggcagggcgggcttcggattgattggacggacggtcatcatgtcagcctgggggagcgggaaattctgttactctccgatctttcaaaaattcaatccatcagccagataaaagagcctatgggcggaattctgattgcggtgaacgccccacaggcccgcgggagcctctctcagctctgcacattgatgggcgggcttgaactggacacactacgcgtcaaagaattgatgtgctgccagcagggatgcatggtcattccgcaaacatcgtggagcgaagtgatctttcgcacctgtaaaggattgactgtcgaacagcggggacggtactgcacctttatggcggtggagctgctctatcttctgagcagcggcagtcaaccgctgccccgtaaaattccttgctcctatctggacagccatcaactgaatgtcgcaaggcaggcaaacacctatattttgacacatcttgacgaagccttgacgatcgatcaattgacccaaatcctgtgtgtttcatccaccctgcttaaaaccagttttcgtcagctatatggacagccgatccgcaaatacatacaggaatgccggatgcggcgcgccgcagagctgctgtccacaaccagacagtccgttttggacatttccatttccgtgggatatggcagcgtcagccagtttggcgctttgtttaagcggttttatcaggttacgccctcgcagtatcggagaaaagcggaagaaaaattgtccaaccccgtcgatttctgtctgaatcaagaagatgaaacagatgtaaataccctataatatttaaatccgctaaaatataggcgcagtaaggaggagattctttgaagcaacaccgtttttgggcctggggcgctgttatttgtatgattatggtcatgatcaccgggtataaacgcaaataaagggaggcatctatatgaattgttataaaaatttggctttgtttgccggcggaatcctgtttggttctgcgggagtcaaactgctcgccagcaaggatgcgaaaaaggtctatacacatgccgcggccgctgcgctgaggatgaaggattccgtgatgcaaaccgtgacctgtgttcaggaaaacgccgctgatatcctggcttctgccaaagatatcaatgaacagcgtgcagcgcaggaaactgtggtcgaagatatgtccgaagaagccggcgaggcgtaacggcagcgataaggagggccgcggagcggctctcctttttgtttatggaggtcaactatgaaatttcaaatcatgcatgaaagcaacggccgtattcgggttcggtttatccaaaaacgaatgacgcttgaacaggccgatttgctggaggcatacctgcaaacactaaaaggcgtatcccaagccgcggtacatgaacgaacctgctgtgcagtgattcgttatcagtcgtcccgggcggagcttttggaacggctcagtcgcttctcctatcaggggcacgcggatcttgtgccgcatcacagcggtcgggcgctcaatcggatttatgaggagaaactggttggcgcggccgcctttaaggcgatccgttccctgttctttccatttcctctgcgggtcgcctacacgttttggaaggctattccttatcttctgcgcgggattcgttgcctttttaaaagacagatgcacgtagagctgctggacggtttgtccatcgctatttccatggttcggcgtgattttgatacagccgcttccgtcatgtttcttctgcattttggggaattgttggaggagtggacgcataaaaaatccgtagacgatctggcacgctgtatgtctttgaatattgaccgtgtctggctgaaaaccgagtcgggcgaggtgttggttccgctaccgcaagtacaggtggacgaccgaatcgccgtgcatgtgggcggtctgattcctctggatggtgtgattgaacagggagaagtcatggtcaatcaagcctctctcaccggtgaatccattccggtgcccaagcgtcctggttcatccgtctatgccggtacggttgtagaggaaggcgaatgtgtcctgttggtgaagcagcaggatggcgacagccgctatgacaaaattgtttccatgatagaacagtcggaaaaactaaaatccgccgctgaaaaccgggccgccaatctggctgacaagctggtgccctacaccttggccggcagcgtactgaccggcattatgacccgcaatgtgacccgtgctctttcggtgctgatggttgatttttcgtgcgccttaaagctggctatgcctttggcggtgctttccgccatgcgtgaagcaagcggatatcacgcaactgtcaaaggcggtaaatatcttgagcttgtcgcccaggctgacaccattgtttttgataaaaccggtactttgacgcgcgcctgcccggtggttgcacaggtgataccgttcggcggccacagcgaacgtgagatgctccgccttgccgcctgtctggaagaacactttccgcattccatggccaacgccgttgtacaggctgcgcgggagcgcggcttgtctcatgaggaaatgcattctcaggtggaatatctggttgcgcacggcatcgccagcacagtcgccggagaaaaagtgatcgttggcagtgcgcattttgtgtttgaggatgaaaaatgcgttattcccgacggcgagcaggatcgctttgacgcgcttttggaggagttttcccatctgtatctggcaatcaacgggaaactggccgctgtcatctgcatatcggatcccctgcggccggaggctgctgctgtcgttaaggctctgcgcaggcttgggctgcaaagaatcgtgatgcttaccggcgacagcgagcggaccgccgcagcaatcgccgcacaggttggtgtggacgaataccgctccgaggtactgccggaggataaggcccattttgtggaatccgcgcgtgccgatgggcacaaggtcatcatgctgggtgatggaatcaacgattcccctgccctgtctgccgcagatgtgggaattgccatcagcgacggcgccgccatcgcccgtgagatcgccgatatcacaatttcggctgataacctgtttgagcttgtcagcctgcgcaagattgcgatgagattaatcaaacgcattcactccaattaccgctttgtgattggttttaatggctctttgattgggcttggggcggccggcgtcctgtctccggccacttctgcaatgctgcacaatctttcaaccttgggggtcagcctgcgcagcatgacgaatttaatctacaacacaacacagccagaataaagcaagccgcgctgcagtagttcatttgggcttgtttgaaagtagaggaataccgaattcttcgcaaacagcttgagaatgcaaaatagaaaaacgcagggacccttttggattccaattctttttaaccagcattcgccgctattggcagaaaacacgggaattttattttttcaaacagcttctcggctgtatggttataatcgttttgagaaagggcgcagccttagggctgcgccctttctctgttgtgcaggtcatccggtcaggacccggagagtattctcatagaatcatgatctgctgcaccccaaagctgaacgaatatttttgtcttattatgagatgaaacgagtgtattctgttcttattcagattgattcaaaagttcaatagtatcaaaataagacgaattttattattcatttttgctactttctataaaaatcacatgtttataatagagaaatatcctttaaatatattttaaatcgacagaaacacttgaaatatttcctgtggtaattataatacagctaccaaaaataagatagtatcaaaatgatacatttcaaaaggcggaggtaaaataaagtgacacaagaagcttaccaaaattatctgaagattcttcaggaggaactggttccggcgctgggatgcaccgaaccgatagcaatcgcttttgcggcggccaaggcgcgcgatgtgctcggtatgcttcccgaccgtaccgttgtagagtgcagtggaaatatcatcaaaaatgtaaagggcgtgatcgtgcctgccaccaaaaatctgcgcggtatggaagccgcggcaatcattggtattgtaggcggagatccatccaagggcctggaggtgctctccggcgtctccgaaaggcatcttgcggttgcgaaggaatggctttcaaggggcgtttgtgagacgaaatggctggacagccctgccaagctgcatattattgcgcggctgtttgcaggagaacacagcgcgatggtcgaaattatccatagccataccaatattgttcatgtggaaaaagacggcaaggtactgacagatattccgcacagcgaggaggaggacagccaacagactgattatgactgcctcaatatttccgacatctgcgattttgcccggacggttaaaattgacgatgtaaaagaaattctcgaccgtcagattcagaataataccagtatttctcaggaggggctgaaaaactcctatggcgcctgtgtgggcaaaacattgatcgacgcgtatggcagcgatatcgaggtacgcgcgcgggccgcggcggctgctggctcggacgcccgcatgagcggctgcgagctgccggttgtaatcaattccggcagcggcaatcagggaatgaccgtttcattgccggtgattgaatatgcgggagagctgcgggtgggccaggaaaagctttaccgggccttgtgcatcagcaatctgactgctatccatatcaaatcccgcatgggacgcctttccgctttctgcggagcagtcagcgccgcggctggagcgggagccgccattgcttatctgaagggtggtgatgaagcggttatttctcagacgattgtcaacacgctgggaaatgtatccggaatcgtatgcgacggagcaaagccgtcgtgcgctgcaaaaatcgcgtccagcctggacgcggcgatccttggctgcgccatggcgatgaagcagcgcggttttcggcccgaggagggcttaatcaagccgacgattgaggagacgattgccagcataacccgtatggccaaagacggtatgcagaccaccgacgaggaaattctgcgcatcatggtgggcgcataaagggcagggaatctgtttgggaacgatctatacaaaacaacaaaaaatgattgacaaagggaggatggtcattaaaaaatgcgtgatgcgccgcattgatacagatgaccaaatagaaagatgaaaagatttctcagtatcgcgttagcaatgtccatgatgttggccgccgggtccggctgcggcaatcaggctgcccccgcctcctctcagggttcgggaggatcggcttccgccgcggataatacggcagaggccggcgctgatactccggtccggattgcggttgcagcccccatgaccggcgataacgcggaatatggcataggtttttacaatgccgccaccctgatggcggagaaatggaacgcagagggcggtgtgctgggccgtcagattgagattgtacagtatgacgacaaaaattcctctgaagaagccgcatcgattgcgcaaaagattgtgagcgacggagatatcgctggcgtaatcgggcattttgcatccggtgtgtgcatggttgccgcgccggtttaccaggaaaatcaaatcatcgaaatttccccgtcgtcctcacatcctgattattccagcatcggtgattacatattccgcaacaacaccgttatagacgttgaggcgtccgccagcctggacattgcgatcaacgacctgggcaaaaagaagatcggcattatcgcaatccagaccgattggggccagaatacggcttccgtcgtggaggagctgattgccggagaatacggcgaaagcggcgcgacgattgtcgcccgcgaggatgtgatggagggttccgacgattacagccctgcaatcaccaagctcgacgcggccggcgctgatgtcgtaatttgctgcggcatgtacagcctggtgggtccggtagccaagcagtataagcagataaaccccgatatcagcatcgtcgccttctccaacgcttacagccagcagctgattgagcttggcggcgaggcggtcaacggcgtgcggttccccgttatcttcttttccggttccgaagatccggccatcaaagagtatgtcgaagcctataccgcacagtttggttcagagccaagcgcgctgacctcccaggcatatgattccacaggtatgctgctagaagcgatcaaagccgccggcaccacagacagcgccgctgtgaaggacgagctttacaagctgaattatcccggcgtaacaggcgacacgcagtttgatgaaatcggcgatgttcacaaggcgtttgtaaaagtcgaaattcaagacggcaaatttgtcgagctgacataaaagcccggcaaaggagacggagcgccccagagggataccgccctggggcctctccttcacaaacgcaaaggggcgttcgcatcgccggaacgcatctggatttgggcaaagccaaacgattcgtccaaagaaccggcgcgtgttgttggcatatgtcccgaaatgggagttctcccgatccccgcagagtatgttcacctgcccatgaagcctgtgccaaaggggttcaggcatactctcgggagcaagtaaacaggaaggagtatgttgagcttcccgcggatctcaacagtgacgactgtggttatacagcaactttttaacggtctggcgcttggaatggcgtatgctctgattgcagtgggctattctcttgtctttggcattttaaggctgaccaatttttcacatggttccatctatgcattcggcgcacatatggcggtgtccttcgtcggttttcaattcggtttgttttttgccatcgcgcttgcgattatcctcacaggcatcctggatatcctggtggataaagcggccctggccccgctgcgaaaaaaaaattcgatgccgattgcatcgctgattaccaccatcggcatctcgcagattatccaaaacctgctgacgattatttatgggagccagcggcgttcttttccggccctttttgattttggaatgatcagcattggttcgatccaaatccattccacgcagctaatgatgtgcgttgtttccctgattctgctgctggtattgacagccatcattgaaaaaacaaaaattggcttggctatgcgcgccaccgaacaaaatacaaaagcagccagcctgatgggcattaatgtcaactttgtgatttcagtgacgttttttctgaccggcgcttccgccgcaatcgccggttcgcttatcagcggctattatcagatcgtttaccccactatgggatttatggccggactgaaggcgtttgctgcggcaatcctcggcggcatcggttccctgcccggcgctgtgatcggcggcttggtggtgggcgtgtccgaaagcctgggcgcgacgttcctcggttccacctaccgcgattccatagcgtttatcattttgatcattgtattgattgtccgcccaaccggcctgtttggcaagaaagctattacaaaggtgtgaaatcatgggcaaagttttaaaaccttcagaaaaccgcctgggcaaacgcgggggattcatattttcaatggaatccttctgtgaaaaatacaagctgccaatttgggccgcggcggcggctgttttgctcggcttgcccctattgggtttgagccaatacctgatccgtatttttattatgattggtatttattcgatgctggcgctgggattgaatctgcttaccggctatacggggcaggtttcgctcggccacgcgggattttttgcaatcggcgcatatgtttcctctctaatgtccatcaacctgggatgcagctttatcatttcgtttattgcgggcgcgcttatcacggcgctgtgcggctttcttctggggcttccgaccatgcgcctttcaggcagttatctcaccatcgtaacgcttggcttcggagagattgttaaaatggtgctcctcaattggacaaatgtcaccaacggcccaatgggtctgaaaaatattcccaagccgaatctgttcggtatggatctgacactggccaacagtggcctgtactatttaatgctgcttcttgttttgctggtatcggtggtatgcgtggtactcatccgctcaaaaaccggccgcgcttttatcgcgattaaggatgatgagcttgccgccaccatgatggggattcgcacctcccgcttcaaaattttatcctttgccttttcagccggaatcgccgggcttgcgggcgcattctacgcgccggttatcagctttatcgatccaaatacctttgtctttgacgtttccacgctgattatcagcatagtcattctgggaggcatgggtaccatgcgcggcatgtatctgggggcggcaattctgattgcattccctgaggtagcgcgctttttgatggactggcgttttgttgtatacggcctggtccttgtggtgatgatgcggtttcgtccgcagggtctgctcggctggaaatcgcagatgccctataagctgccaaagctgacccgcatcgctttagaggagcgcaaagcccaaagggcggccgaagcttaacgcggcggccggattttgcagagaaaggagcgcggcccggccttggttaatcaggatgggccaaaaccattacaatggctttattatccgtaaataatgtcacaaagcgattcggcggcttggttgcagtggatcatgtcagctttgaagtcaatcagggcgaggttatcagcttgatcggcccgaatggagcaggcaaaaccactgtgttcaatatgctcacaggcgtgtaccagatcgacggcggcgaaataatttttgaagaccgtcccattcataacctggctccgcaggagattgtagctgcgggtatttcacggacgttccagaatatccgcttgtttgggagtatgcgcgtggtggaaaacgtattggtaggcacccatatccgcacgcggtacagctttttcgattcctttttccgcactggacgctttcggcgggaggaggcgaagcagacgctcaaggcgctggatattttggattccatcggtcttggtcattatgtgaacgattacgcatccagcctgccttatggcgaccagcgcaaggtggaaatcgcccgcgccatcgctactgacgcgaaaataatcctgttggatgaaccagccgcaggtatgaacccacaggaatcgctggagctgatggagtttatccgttccctcacccgcaaaggctataccatcgtgctgatcgagcatgatatgagcgtggtgatgaatgtttccgaccgtatttatgtgatagatcacggcaagccgattgcgcatggcctgcctgatgagatcgcaaacaatgaaagagtgatcgaagcttatctgggaggagtgaaaaaatgctgaaggtcagcgggctgcatgcgttctacggcagtattcacgccttgaaaggcatcgacctcgaagtccatcaaaatgaaatcgtctcgttgatcggttcaaacggagcgggcaaaagcaccgccctcagcgtaatcgccggcctggtgcgttcctcgtccggaagcgttgaatttgaagggagaaacatcaccaaccggcctgcatttcaaatggtgaagctggggatcagcctttctcccgaggggcgggaggtttttccggcattgacagtggaacaaaatctgcgtctgggcgcttatatcaagaaggataaagcgattgaggattcttttacccgcgtgtacgatttgttcccgcgcctcaaggaacgcataaagcagcaggcaggaaccctttcgggcggcgaacagcaaatgcttgccatcgggcgcgcgctgatgtgcgagccgcgcctgctgatgcttgatgagccgtcgctcggtctggctcccaatattgtattgcagatttttgatctgatcgaatcgattaacaagcagggcaccaccatcctgctgatcgaacaaaacgccaatatggccatgtcgatttcccatcgcgcctatgtgatggaaacaggcgccatcgccatgcatggcgacgccggagagctggcaaacgatccgcgcgtgaagaaagcctatctcggcaacaaatgaggaggggtatccattgaaaaaaattatcaacaacgcaagcgatgtcgttagcgaatgccttaaggggttggccagggcaaatccccagttatgttacaccgaacagcttgaagtgatctcgtgtaaaagcaagacgccaaacaaggtaggggtggtttcaggcggaggttccggccatgagccggcccacgcgggctacgtcggcaagggaatgctcgatgctgctgtcgccggcaacatgttttcctccccaagtcccgaccgtattatcaagggtatccaggaggccgacagcggcgccggcgttttgctggtgatcaaaaattattcgggagatatcatgaattttgacatggccagggaaatggccgaaatggacggcatacgcgttgaaagcgttgtagtgcgcgacgatgttgccgtcccggacagcacgtactcgaccggccgccgcggcattgcgggtacagtctttgtccataagatcgccggagccaaagcggagactggggcgagcctcgatgaggtcaaggcagccgcggaaaaggcgattgccaacattcgcagcatggggatggcgatgacgccctgtaccctgccggcggttggaaagccggggtttgaactggcggacgatgaaattgaaatcggcatggggattcatggcgaaccgggcgtggagcgcaccaaggtattgtccgccagggagacggcgcagattctattggataaaattctggatgattatgatttcacaggcagcgaagtggcgctgatggtcaacgggctgggcggtacgccgctgatggagctgtacatcctcaacaatgacgtccaggatattctggcgcaaaagggaatcaaaatctataaaacctttgtaggcaactatatgactgccatcgagatggcaggctgctcgctgacgctgatgaaactggatgaagaattgaaggagctgctggatgcaccttgcagcacaactgcacttacgctgccgtaatgaatggagggacagccttatgggctttcagctaacaacaaaggattatgtggaatatatcaaaaaagcatatgagaaaattcatgccaacggcgattatatcacggagcttgattccgccaccggagacggcgatcactggaccaatatcaatatggggtttgaaaagctggtcgaagcatccggcgaattggaaacaatgagcctgtttgacgcctttaaaaagatcagcatgatcatgatgtccgtgatcggcggttcaggcggcgttttgtatggttccgcctatatggaggcggccaagcagctcaacggcaaggaaacgatccagaatgaggagctttgcggtattctcgaagcgatgatgaatggcattatgaagcgaggaaaggcaaaacccggtatgaaaaccatgctggatgctctggcgccggctgccgcatgttatcgtaaatgtatcgccgacggcgccgatgaaaaacagacgcttgccagagttaaacaggctgccctgctgggagcggaaagtaccaggcaaatggaagctgtacggggccgcgcctattatcaggcaaataagggcgtgggaaaccttgatccgggtgcggttacaatgtcctatcaaatcgaaactctgatggactatgtggaaggcaaattgtaagccacacaggatatgtcctgcgtcggaaaggagcttggaatgaccaggaagctggcagagatcaaggaagataccgacaagtttggcgaagtgatcgcccgtactctggatgtggatgtcttgatcgtggacagcggattgaagaatgtcagcaatacttttcgttatttcgataaattcacagtgatccaaccctcgtctgtggtgggcagggtgatcgccaccggagaaacggtaacagtacgcgaccgccgtaattatgacggttgccggcaatgtgctgattacgatgaatgtgaaatggtggggtttatcggcgtgccgatccgttatcagaaccggacggttggagcgattgcgcttgttcttccaagacatcgtgtggagcacatctttgatgatattcataactcggttgcttttcttgaaaatatggccgatttgctgtccagtaaaattcgcgatcacgacgagtatgacgccttgagaatcattcaccgggaacgcgagatattgatggacaccattgaaaacgccatcgctttggtggacgagctgggttatgtcacctattgcaaccgcaactttcaaaaattttttccttcaaggcccgatttgacgggaagcccgattcgggagctggtgccgcacaagctggttctggaattgttggatacgccgcaggagatcaataaccgtctgattcaaacggatttggaaggcggcgccttttacggcctgctttcctgccggaatattaatattgacggcgtgcgcagaggcatcctgcttattttcaaatccgcaagctatatgagcagcgattacaatgagcttgttcattgtaatgggagcatgacctttcaatggggaaatcgccgtctgtttccgcagcaggtggaggagcaagccaagcggctttctatctctgataaaccgattttgctgacaggagagcatggaacaggcggctatatccttgcaaaatgtattcaccagttttccaaccgcaaggaatatcccctgctgacaatcaattgcagccgcttataccgggatttgctgtacgaaatgatatttggggtgttgggtcgattatatctggccaacaacagcactttgctgcttcataatatcgatcaggcccctctttacatacagggaaagctggctgattttattcggacatgctctctgcgcaccggtgaaaacggcgttgttctcaagttgaatgtgcggttgattttttcgacacacgctgatctgaaggaaatggcgcgcaatgggctttttgacgaaaatctgtattaccgcatatcagaaaatgtcatccacctgcctgcgctgcgcgaggagcctgacctgctgaaaacattgatccgttcgggtagggatttttattgcgcacaggccggcggagaaaaaatgtcgttcagcccggaggtatatcgcgctctaatgcattatccatggccgggcaatgtacaggaggcggagtacgtaattgatcagatcgcgtcgcattgcggcggcttaatcaaaatggacgaccttgccaagctgaatttgattcagccagagaaggttaagtctatgaaggagatcgagcgggagatgatcaccgctcaactcaaatcgagccgcaataaggacgatattgcgaaatcactgggtatcagccgggcttcgctgtacaggaaaatcaaagactataatttataaaggagatattgtcatgattgaaaacaaatgtgaaaacagaggacagcactgcgaggatatgcgcgcagcatttgaacaccgcgccacgtggttttataccttgatcaatgaggcgcgcaaaaagggcttggattatgatttcgcccgcgaggcaattctggcctgcggtcgttttcacggcgatcacaagtacaccaaaacagatgatctgatggtttttgcccctgaatttgcaaatcaaaatgtcgtcgatatttttgaaatggaagttttaagggcggatgataaaaacctggatatcgatttccactattgccctcttgtcaatgcctggaaaaagttgggcgtcccggaggatgagatcgctacactgtgcgatatcgctatggacggcgaccgcggcattatcagtacctttcccaagttccgttttgaactgggcgcgacaattgcgaaaggcgataaggtctgtcaaatccgcatcagcaaaactgccgaataagcttttaattcaaagcatataaaaccgggtactaaccgggtttgggctgcataccaatatgaatatcaaaaagaacgtatggtcctataaaatgagaccatacgttctttttggcgcgctctatgagcgccatatgtttgacctggccgttcaatcatcataataatgtccgctggcttctcgcttactgagagcgaagcacattacttactccaatttctaaacagtttcggacaaaattttttatttgacgcattttttgtttgactattatgcagtatgtagtaaaatagaaggtggataataatattgtggcgtctttgcgggtggagcgtctgtacgctgccgcgtgaaatccacggccacaggagggtaattatgggcatgaataatcaaacggaaattttgctggaatccggaaccaatgagcttgaaatcatggagttcactgtcggcggcgagatctttggcatcaatgtcgccaaggttcgcgaaattatgatgtactgcgctgtcaaaccgatgcagaattcacatcctgttattgagggtgtttttaaaccgcgtcaggaattaattaccgtcatcaatcttgcggattatttggggcttccgccttcacaggacatcgatcatgatatttttatcattgcaaattttaactcccttaactttgcttttcatgtacatagcgttgttggaatcgaccgaatttcctggcgcaaaatccaaaagcccgataaaattatctacggcggctccgaggggatcgctaccggtatcgccgaatatgaggaccgccttataacgattcttgattttgaaaaaattgtcgctgaaatttgtccggaaaccggcatccagctcgaggatcttgaccagctcggcaatcgtgaacgctccgacaaaaaaatcctgattgccgaggattccatgctgctttccaagatgattattgaatgcctgcaccgcgccggttatgtcaacaccattaaaaccgacaacggccaggaggcgtggaattatcttgaggaagccaaggcgagcggtgatcccatctatgagcatgtcaatcttgtagtgactgacattgaaatgccgcagatggacggccatcgcctgacaaagctgattaaggacgatcctgcgcttaaacgtctgccggtcgtcctgttctcctcgctcatcaatgaggagatgcggatcaaaggcgaacagctcggcgctgacgcacagattacaaagcccgaaatcgccagccttgttgaattgatcgacggcctgcttgaacagcaggacgaagtgtaaaatctcccgtcacatctgcgtcctgtatatctgcggtttgccgcggatatacagggcgtccttttattgtcgaaaagaaagggccggacagccttatactgtccggccctttttcctaactcgtcagatccgtgtgaccgcgattgcgtcaagaatggttttttcctttgcaagctggccgtatttattgacctcgctcttgtctttgggaccgtgcgtgatacatgccgccccaccaatacagccgccgatgcaggccatcccttcaatgaaattattcggcagcatgttcttgcgcgccttaaacagcgcggtacggcattcctcaatgccatcgcacgcgattggattcgcttgaaattgctcctcggaaatcccatgctctttcaatgcctgcgccacagcgtcggaaaggccgccgctgcgtgcgaaaatacgtccgtaatacgaggcgttgtcaagcacgctctcctccaggtgttcaattgtcacgccgcgcgcgtcaaagagcgcctgaagctcctcaaaggtgatgacgcaatcaatccctgtacatgcttcttgttgaaattccattttcttagccgtgcacgggccgacaaaaatacatcttgccgtcggatcggtgcgcttgataaaccgcgccaccgcctccattggcgacggattgtgcgaaatatggttcgccaaatcaggaaacgcgcttttgacataggcgacaaacgccgggcagcaggagcttgtcaaaaagcccttttccgcaagctcggcggcttcgtcatacgcgaccatgtccgcaccgagcgcggcttcaacaacgctgtgaaagccaagctttttgagtcctgtgaccacctgtcctgttttggcgtaactgaattgactggagatggacggcgccactacggcgtatacacggtattttgcattgttttcggaatcgcgcatcatggtcagcgcgtccaacacaaacgatttgtcgacgattgcgccgaatgggcattgatagacgcatgcgccgcaggcaatacacttgtcattatcaatctttgcggaattatcgcggtgcatactgatcgctttgattttacatgcattctcgcatggacgcgtatacttcataattgcggagtatggacacgccgttgcacagcggccgcattcgacgcatttttcctgatcaatatgcgcttttccgtcatgcacggaaatcgcgcccgtcgggcaggcatgctcgcagcggtgcgcaatgcagccgcggcacgccgaaccaacgtgatagcggttaaccgtacattcatcgcaagcgatgcggatcacctcgattgcattcgggttttcatggtcgccgcccatcgccatgcgcacgcgctcagtaataatagcgcgttccttgtagacgcagcagcgcatcgtcggtttgggtccgggcgcaatcgcaagcgggatatcacggtacgcgctttcaagcgtacctttgtcaaaatgctcgacaactcccttgattaccttgtattttaaaagctgcacattggtgtcaaagcttctttccgtcgtttccatctggtttcctccctctgtgaaacgatcagggcttgtttgaaaacagaaaatttttagaagttttcaaacagtctctaatagtaattaaccgaaacgatcttacccatcttttcaaggcactgagccagatcatcgatcaggcgcagcttgattgaaaggtcaatcggcatatcggggttttgatgcgccgggttcatcgcgcggccgacaaagagattgacgtccgtcgcatcctcaaacagcatctgcgcaatcagcgaagccccgtcgcgcttggccatccactcgctgtaagcgtccgatgaggaggcgtaccgcttcgcaatctccacgacgcgtttcattgtcaggacgccctctgtacacaggtcgacgccttcgatataaccaatcggaggaatatccgggtctagatagtcgattttcgttttgacctccgtgccaaggtaacgggctacgattgacgacgtcgtgccgccgcagacaatggttttcccaccctgcgcgaaaaacgcctccataacttccctgtcctcggccggattgaccggcgggccgatcatcaaactgacaagttcgcgttcgcgtatacgcagcgcggccacggtcgtgtcgtcgccgggacggtccatatacagctcccggcacgcgtcgctgatcagcgcagcgattgcctttgcggacatgccaggcgtgtattttcgttccgtatactcgacgacattcggccgttcccatccaaagttgagcgactgcccgacgccggcatgaataacgccgtcgctcatcgcgataaagacatcgcccagacgcaccggaaagcgcgattcaaaaattcgtttgcccgctatgacgtgttccgtcttttcatagtcgaagctcttgccgtcgcgcagcataatcacatccggattgtcatactggacgagccgcacctcgtttttatgtacctgaatcgctgtaaacgtcgcataggcaacctgacgcaccgaacagaccggaagcgtctgcgcaatcgtattgacgcagtcctcaacagtcatttccgaatccatcatcgtcgcgatgatctttgaagtcaatgtggacaggatgttcgccttgacgccgctgccaagcccatcggccagtaccatggtaaagtcgccgttcggattgtttttgacctcgacgcggtcgccgcacagctcctcgcccaccttgttcaagctgatgtagccattctccataaaatatttatccatgctactcgtcctccgagcgcacgatatttttgatctgcgacagagcgatctttgtttccgccgttgtttctccaagaagcgacgcgatttcctgcacgatccgcatctgcttttcaatcaccttatcggtgatgtcgatcgtcttggcacgtttttcaatatatttttcgcgccggttatgctcggctgtgatatctttaaagatgccgaacagcgaatggtgctccgcatcgagcacaacagacagttccacatacagatcgtattccggtatgtatatctttttgtcaatgatatcgtttcccgtatcaagcacgctctgaaattcagtcgggtcgatcagatcgatgacgcttgtaccgatgacctcctgtgaacgtgcgacgccgaacatatggcaggcaggcatattcatacgctgaatccgcagctgctcgtcaagcacaaggatcgcattgggtgaaacggcgaatacattattggaaaacgactccgcgttctcaagcaaatacggcaggcacattgtgatgtcggccttgccgttgtagacggctttcgccttttcccggcaggtcggatagccgcacgagccgcagttcagctcatgctccggccgcgtcttgcccatgcgcgcaaggatttcaatgatcgtggcttccggtggttccggctcgtggacaaattcgtttgcgatgtggcgcgaaagtccaaattcgcatgcggcatcaaaatcaggcttttgatgcatatccggctgcgcatactcatcaacgcgcgcgcggcttgtcaggatattgtccctgtaggcgcgtgtggacggcccgttgatgcagcttccttcacacgcgctcatctcgacaaagtatcccttgagtccgccgcgttcaatttctttaatcgcctgcacacagttttccacaccgtcgacagcgatgtatttatatgtactttcctccgtgtgcatacacgcgatgattccgcctgtgcgcggaaaaaagcgcgaagcgcggccgccctgcgcgtcaacctcctgcttttggagcacaatgccgcgcttttcaaaccactgccacagctcgtcaaacgtcagaacacaatcgacatagcccggcagcttctccatctcgtcctttttggaaatacacggcccgataaacacgacatatgcgtcgggatattcctgcttgatctgccgtgcacacgccatcatcggggagatgatcggcgcaatatatgggatcacagcgggataatatttctgaatcagcgtgacgactgtatgacagcacgacgaaatgatgacgtcctgcgttttttcgcgaatcatccgctcataatcgcttttaacgatatatgcgccctgcgcgacctcgcgcgcggcaaaaaaaccgaattttttgagcagttcttccatctcctcaatcccggagacaggaaattcgctgataaacgccggcgccaacgccgcgatgacacgtttgccagaaccgatcgcaccgatgacctcggtcagatcgttgcgcacgcgtttggcgttctgagggcagacaacgacgcagcgtccgcagaggatgcattcctcaggaataattttggcctggttatcggaaaaacggatggacttgactgggcaggaccggatacatttgtgacagtttttgcagtttgcctttttcaggctcaaaacgtcattcatgattccttcagtccctccactacctctttttggaacacttcggccgcattttcggcgttcagtcctgtcacaaggcggtcgtcaatcttaatggtgacgccgttctggcagtgtcccagacaaaaggacgcattcagattgaccttatcctcaagatgctgctgcgcgatctgctgcttaaacacattgatgatgtcatacgaacccttcaggtgacacgagcttccgatgcaaacatagacttccattttgcttcctccagtaccacagtttcggccgcgtcgcacgcgcctattgttaaatttctatcaatataatagcacaatcgtacccccggcgcaaccatccgccgcaaatttacgcgtctatacggacagcagtttcctgcgcgctttataatcgggcatcagccgcgccatcatgtcgtgaaagcctctttgatggttggggtgcagaaaatgcacatattcatgcagcacaacatattcaaccgcctcagccggctggtccatcagttgtgtattgagcgtgatgcggcagcgtcccggattgcagacgccccaccgcgttttcatccgccgcacgcgtatctccggcttttgcggcagcacggatgagaacagcggataaatccgatcgctgaccgcacaaaaagccgcgagacattcctcatccgtgtaggcggcggatgaacgcatctgctgcgtgtgcagccggacacgctcacgcgcccgtttaatccagccggcgtgcgcctgtacaaaggcgtcgatctgccgcagcggcacacgccgcgccgctgaaacgcgcacggaaccatcctcgccgacacgcagattcaggtttttgacacgcttatacgtcagctcatattccacgccgccggctgtccgtatcaaatgtgtctcccccttcccattgctgcatgttgccgcctgcgcttttctaatatttcccattcaaaaaacaatctcaaaatgatacccgctttcaatgccgacgcgccggcgcgtcagcgaacgcacctcagcgaagcgcggcccttcgcgcacaagctcgaagaacgcctctaacgcggccggttccccctgcgcttcaagctcaaccgcaccgtcacaacggttgcgcacccatccggtcaaagagaagcgcagcgcacagcttcgcacgaaccaccggaaccctacgccctgtacttccccctcgatcagcgcgtactcgcgcactgcccgcgcgttcataagcgtttttcgatcgcatcgatgacggcgtgcagcgtgcgcaggcgcgcgtaccgcttatcgttcgattcgataacgaaccagggcgcaaacgatgtgtttgtgcgcaaaagcatctcatctaccgcctgctcgtaggcgtcccatttctcacggttccgccagtcctcgtcggtgatcttgtagcgtttttccggcgtattctgacggtcgttaaaacggcgaagctgttcgtccttatcgatgtgcagccagaatttcaggatgattgcgccccagtcggccaatccccgttcaaaacggttgatttcgtcgtatgcacggccccattgctcgtcggtgcaaaagccttcaatatgctccaccagcacgcgtccataccaggtgcggtcaaaaatggcgacatgcccatcctttggaagggtgttccagaaacgccacagatgcgggtggttcttttcaaccgtgctcggcgcggcaacgggaaccacctcatagccgcgcgcgtcaagcgcctgcgcaatccgcttgatattgccgcccttcccggccgcgtcccatccttcatatgcgaggatcagcgggattttttcaagatacagccgcccatgcagttcggacaggcgcttttggcagttcttaagctccttgcggtattcctcctcagaaaccgatctgctcagatccacatcgcaaaggcgcgcgcaaggctctgtgcggatatcgtcagacacacgaattcctgtaaacggccgctcgataccactctgccggtcctctatcgcgcgttcgagcgcggcgatcaccgttgtaaacaccttatgtgtcgcataacggcggtctgtcgcggccacaacggtccagggcgcgttgtggcggtctgtgcgggaaatcatttcatcgaacgccgtcagataatcgtcgtaatgctcgttgtgatcccagtcggcctttgttacgcgccagcgcgtcgcctttttttcctccagggctttaaagcgttttttctgttcttttttcgtgatgtggaaaaagaatttgacaagcacatagccgtcgtctgtgatctgatgttcaaaatcgacgatctcatcataacggtgattcagctcacgacgcgaaagcgcttcatcctcgcgcgccaccgaaacctcccggtaccagctacggtcgaatagagcgatatctccatatgtcggcagcttttcccaaaaccgcttcatccatgggtatcggcgttcatctgtgcttggcgcggtgatgctgtgcaccgaaaagccgcgcgggtccagatttgtgataagccgggaaagcttgtcgcctttgccggacgcgccccatccctcgaacacgatcaccgtgggaattttgagggcgcgcgcacgctgctggagcacgccgagcttctttttcaattcccccgaaacagcgtcccattccgcctgatccatccacatgtcaaggtccagattttccagcatatgatgtcccgcctttccgcgcagcgccgattgtggcatccgcgtgattcgtttatttttatggtattataccattaaaaattgcgaattacaatgaaattatcgtctattatatacaaaattcacttctcatctataatgttactgtccgtaggacaaagtcagcagcctgtccgcagacggatatcacatacccctgctccatatatgtcgcaatatcggtgcgaccgcacgtctcgaccgtattcagcggcagagtgaaaccgcgcccatcgcgcttgacaaacgcttccttacgcgtccatacctttagaaaccgtgcggcgtccaccgcatacgcacgttcacgcggcgtaaagcttcgctctgcgacccgcatattcacccgccgagcgaaggattcgatatcaacgccgacagggcgcggcgataccgcgcaggcaaccgcgccgcgcgtatgcgcaaggctgatctgccgttccggttcctccggcaaaaacggctttccatgcgcgccatacgccagacgcggcatatacccgagcgcccgcgccaaaagttcgcgcaccgcggccgactggtcgggcgcgtccgtctttgcaaaccagacgatgtgctccatcatgcgccctccctgcggtaaagtacaatccaaaaatccgcctccgtgtgcaggcaatcgcataacgacagcctttgcgctccctgcgcgggcgtcctgtaataatagggcgtcatcataaaaaggctcttaatcaaatcgtttccattcaacgtaaattcatacgaaattctgcggcggctttcgatacaaaaaccttccagttcaaatgtcttatccgggttttcatatggatgctcatacaaaatttcttttagcccgtacagatggcgggcggccggatataccgccgcaaaaacactgcccggcgcaagcacacgcaaaagctccggcgcgcagagcggcgaaaaaatattgcagcaaacatcaaacgcaccgtctgaaaacggcagtgcgaacaaactggcaaccgcaaaatgcgccgcccggcagcggcgcgccgcatggcgcaccgccgcctttgaaaggtcgacgccatagagcgcggcatcctttccagccgtgtgcagcgcgtcatacagccgcgccgcataatacccctcgccgcagcctgcgtccagaatgcgcggcgcggcgcctgcgcgcgcggcgatctctgcattgagcgtgtcggaaagcggcgcgtaaaacccgctgtcgagaaaacgcgttcggctggcaaccatttcagcgttatcgcctggattggcgctgtttttccgattagccagcaacagattcacatatccctgcgcggccagatcgaagctgtgatttttcgggcagcaaagcgcgcgttcccgcttcatgagcgcacccttacagattggacaaataaacataaagccgcctccatccccgccgcttccggccgggcgtttccccaggaattcatcaaacggcgccctttgggcttgactgccgcaaagcggcaaagtcgtttgccctgcgcatattgtaccaagattcggcttacccgtcaatttacagtttttccaaccaagtctgcagtacttgcggctttgtgcgatacgcattataatagaaacaacaacgctgaaaggacgaggattgaccgcatgtctatcaaactgatcgctctcgatatggatggaacgacgctttgcagcgaccatcatacaatttcccaggaaaacctcgatgccatggccgacgcagccgcacaaggcattctgatcgtcccagccaccggacgtatttgtaaccgcctgcctgaaataattgaggctcaaccgtggctgcgctatgccgttacagtcaacggcgcggccgtaaccgacttgcatacaggaaaatcgctctataaaaatcctctgaaacgcacagtcgcattgcaggtgtttgatcttgtggaaccatatccgatctttatcgagatttactgtgacggcttggattatattgaggaacgccgtatgccatatttttccgagctacccatcagcgaggagcgccgcagcatgatgctgcgcggccgctgttttgtcgaaagtcagcgcgcatttcttgaagaaactgacggcgcgattgaaaaattcaatctcccctatctggaggacgaccttcgattgaccatcaataaacagctctccgctcttgacggcgtgacgctgacctcctcaatcgcaaaaaatattgaggtcaacgcagccggagccgacaagggcgacgggctggcgcatctgtgcgcacatcttggcatcgcgcccgacgaggtgcttgcaatcggcgacggcgaaaatgatctgaccatgctgcaattcgccggtatatccgccgctcccgccaacgcttgcgaacaggccagaaagcttgccggctggatagctccctccaataatgaaagcgctgtggcgcgcgcgcttgagcattatcatatcatttagcggaagtaagggaccgcccataccttgaggaggcccgtatgacgccgatggagcatgttgacgcatataagaacctgtattcacagccgcaaaacgccgtccaggcgggccttttgtccccgctccacattaaattttcttgccgggcgacagcccgcctgcaaaaatttgccttgatcgggtacaaaatccctcgcctgtccagtatcctccggctgtgaatacaggttctaagatcagcctcgagctgggactttatgaattggatgatctttccgattttcttgaccggcaaatagaggtacttgacaacgtaccatatatatacattgatctggctttggcgattcctttaggcttcaagcatgtctttcactgtatctcggagtatttttcagacaatcgatacatccccgaaaaccggccggactgccctgtggaaaaaagcctgatcggcctgatccgtgacagataccaatccggcgaggcgacgcttgagcaaacatgcgtatggctgcaccggctttctctctattttgagccgtactctgtcatgaacgccgtcgaggactattacaggctggcacatgaagaaattgttttctcaatcgatcaggtgaaaaatatggtggaggaaatcctttcacgcggtacacagatataacagccctacggctggaattggcataacatcttgagcgcagcacgcaaaataaaacgattatgaccgttaaaatacaaagtgcgcctgctccattggagcaggcgcactttgtattttgccgctctgcggtacgatgaaattattctccaaagcggcagcggaccgcatccgtatatctccctggctatgaaagaacagatatcagccccgcggtcattcatcacagaatcgccatcagccgcaggaagtaccaggccggcgacagaaagcgcagcgcgcccatgccggcgggcagcagcacaggatcgacgattgcccctgagcagataatgccgatgaacagaaacggcggtaaaagcgcaacgacaatacccgtccaccggcgcagccgcgacatgagcggactgataacagccatcaatacagacagcgcgcaaaatgccaacacgcgcgcgcctgcaccgtatgcgccgtcttgaagaaacagcgcatgcataagcccgtctgcggcaagcagcaccgccagattgatcagcacgccggccagcgccggcgcaaatgcagtcacggctctatggccggaaaacacagccaactgacggtacgcggcggcacggcctcccgcctcaagcagagcagacaggaccgtgacgccgaaaaatacagttataagcacagcgtaaagcagcggctgtacgccgctgtctgtcaattcctctattgaagcgccctccccgcgtgtgtgcagctcaagcgacagcggcggttcgctgatacgcagacgctcatagatcagcgccgtgttgctgccgtcgatgccattgtcctccagaaaagctttcgccatcccgggcgcgcgcgcatccatatatgccgcaaggacgatttcatcggttagcggacgcatataggaggcatctgtcaaataaaccgttacaggcggctccatttgatcgtccagccgatatccgcagtggaggacgcccgcaagcacatcgcggcgcaacgcgtcgtcatccgtgtagcgtatcaccgtaaaaccggcgttttcaagcaaggcgtttgccgctgtcgacgctatatcgccggacactgtcacgccgacctgcaaatttacgccgttgttctcgggaagcactgcggccagcagaagcataacagcgagaaaaaaagcggttgacacataaaacgccgctgaccgcagcaccgatttgagctgtacaaaaagaagcgctgcaaaatagcgcatcattattcggccacctccccacgccgccaaaagactgctgcagctaagtacagcagaacgcccatagcccatggctgccaaagctgtgcagccgaaagctgttcgccgaacagcgcagcgcacaggcgcaagccctggccgaccggcgtaaacggtgcgatccgggaaaacacctctggcatcagagccagcggcaaaaagcaccccgcgcacagccctgtccccacagacagcagcaggcatgcgccagcgcacattttccactgtgaaaagaacgttgacagcgccgcggcaaacgcagatgcaataaacgcaaaaccaatatataccggcagcttgcccgcggcaaagccgtcgagccaacatgcgaacaaaaagatcggaagctcagccatgagcatgagtaaaaagacatgaagcccagccgcggcaaacagcccgcgcgcatgcgcagcgcgggcaaaacgccgcaaatcctgtatcgcgggctgaaagagaaagccataacaaaaaaacagggcggaaactgccgccgccagataataaagcggcagtgacaatgcgcccgatgcggatagcgtctgctcctgcaccagagagaggcggtccagaaacgcgcgtacaaacagcatattgattcccataaccagttgatcgtattgccgcgccgacatcccttctccataagaaacggattcctgaacagtgtaaacgccgcgctgtgccgcggttaaatcggcggccgccgcgtcaagaagctgtcgcacccacattgcttccagaggggatgaaaggtccagctcgataacagggcttatattttctccatttaaaatactgtcgatgaaaccctctggaatggttatgacggccgcatatgaaccgtcacgcgcctgctgcggcgtcacaaactgcatatcgagcagcttttcagcgctctccattgaagcggctgaacgaagcgccatccggctgatgggattggtatcaagattgacgacagctaccgccgcctttggctgctcctgttgcggcaatacggaaaaagctgcgtatccgagcgccgcgcagactccaagcacgcaaagcaagcacagcagccgtcggccgctgtgcttgcatacaatcagaaatgaggttgcaaacagtctcatgttgttcccttcgcaggctcttttcagctgttagtccgtcaaggccaatcatcccattgaggcgctcatgatcaaaggcagcagcttgccgagcgtcgcattgagtccgtcgttatatttctgaagttcagcgtcaagctcctctgccgtcatgccaaacaaaggcgtctgcgcgccgctgaattcatacgggccgtcgatcggttccgaatcggccttaaggctgaatacgattcccatcttttcacccgccgcagtaacagacgccgacaaagtcggaaaatcatacgttgttttgccgccgtcggttgtaatggcgccgctgccgccgatatcataagcaaaatcgctcgtcagggcatccatggggattcccatatggaagttcatatcaaacttgccctcttggtcggccgtcatatccatcgccatgttgatggcggccgcatcgccgcccatgctgccgggcgcgttctccaaattcatatccatcgtaaagtcaacatcgtatacgccgtcctgataggaatcggacacatccattgcaagcgtcattgtctcgccattctgagacatgacggcctgtgccgttagcgattcgtctccgttttcagcgatattgaaatcagcggtcagcgattcgatcgtcacaccgtcgatcggctcggccggcggcgttacctcgaaatgcatggtctgaatctggtttttcgcgccgacgccgatcgtaatagtcgtatccatctcgggcattccggcctggagcggttcgatcagctcttttgtaaacagatcggcaaaggaatccgcgccgtccaatccagcggtgaacataccgctgtacatctgcccaagctctgaatcgacatagatataattgaccaaatcgatcacaaacgtcttaacgtccttgcccggcactttaatcacatactgctgcaagccatctgccttggcgcccttttcataagccgcgttttcaagcgccttgccggcgatcgcatacatatcggcctgcattttcttataatccagcccatagaatgcgcctgacataccaagctcggagctcagaagctcctgcatctccataagctcctcgtcgcttgaatagccgtcgtaaagcgggctgtttttataatcctgcgcaaaggtctgcgggttgatcgacagtactgtgtccgagaaggtcggaacatgaaatgccagcagatccggcgaaatatagccgtacagctctaccaggtccagatcgcccaaatgcagcgaaccgctcagttccgtgatggaattttccggatcggaaacgagattgccgcggacgcccgcgccggccagcaggctgttgaccagagcgatatcctcctcgctgcccgcgacgtctgactcaatcccgacaagctgcaaatcatacgtcgttttggatgccttcggctccaaattgctcatcacgcccataccgggcacttccgccataattttatccgcgcgggcctgaattgatttgttcgtcgcttcaaacgccttgtcgactgcggccttcgggtcgcccgatgagaaaacgccggaaaacagcaacacaatcgcggctgcaagcacaacgatcacaccgccgatgatcagcggcagcttattggaaccgggtttgacaaccccggcgcctgtgtccggagcgggttcccctgtattctccggctgtacgtccgcctgcatgggcgcaggcgccgctttttgcagatcaatctttggcgcgtcgtcagcgccggcattagactgtgccgagccttgttcgttcataccctccggcatgttctgttcatccattcaaaatgcctccttttcttcctttcagcggaccatgcgatccgcagcaacaagggcgtggatatcctacgcccgggataactgctccgccgcctgcaccatgcggcatgcttcatcacccgtcaaggctgccggcgaatcgacgcggccgccgcgcagcaggaccataacatctgcgacagacgcgatggcggaaggatcatgcgaagaaaacagcagacctgcgccgcgctgctttaaaccgcgcagcagtgctgcgatatcggcccggcctgtcacgtcgagcgccgtaaacggctcatccatgatgagataatcaggccgcgcagcaagcgcgcacgcaatcgccgcgcgtttttttacgccccccgaaagccgcgatacacgccggccggcaaatgcgcacaggccgagcgcccgctcgggcgaatcggcggaaaacatggcggaacgcggccggctgcatgcggcataccaaagcgcaaggttatcacgcaccgacagatcggcaagcagagctgtttcctgcgggacatatcccactgttccgtcgcagcgaacttcgccgcggtcggccttctgaacgccggcggcaatagtcagaagcgtcgtctttcccgccgcgttcgcccccgccaggcatacagcctgaccgcgctcacagcgaagcgaagcgccgtcgagcacgcgcgcggaaccatatgatttaaatatttccgccaactccagcatccgcatcccatcctttcaaagcagtatatcatactttcctcaaacaggcaatcgacttcctaaagtttcctttttattcttttgccaaatgcattttttctcttgcggtacagagtcactctgacgtataatggacttgtatccggaatgcttaacgatttaagaggagcagccatgtcgaatcatttccacatcggccgaagcgatctgaaaaaatttttgcttatcacagtcagcaccctgattgttgtatgcggcacacactttttcaaatttcctaataacttctcctttggaggcgtgacaggctacgccgttgtgctcgcggaatttctgccgttttcagtttccaccatcaactttgtaatcagcatggctctgatcgtgattggcttcatctttctcggacggtcgttcggcgcgttgaccgcctattccagcgtgctggtgtctgtcgggttgtctgtgttggaaaagctctatccgatgagcgcgccgctgaccgatcagcctatgctggaattatgctatgcgattgcgctgcctgcctttggttccgcagttcttttcaatgtcggcgcttcgagcggcggcaccgatattgtcgccatgattttaaaaaagtacaccagcgtcgatatcggcatgtcgctctttctaacggaccttgtggttgccgtgtccgcctgctttgtattcgatatcaagacagggcttttttcctttattggacttatggtgaaatcactgatgattgacaatgtgattgaaagcatcaacctttgcaaatatttcaatattatctgcgacgatccggagccgatctgtcgttatatcgttcatgaactgcaccgcagcgccactgtctgccaggcgcagggcgcttatacgcatgggaaaaaatatattgtatttacggcgttgcggcgtccgcaggctgtagcccttcggcaacatgtccgcacggttgaaccaagcgcatttatcctgatctccaacaccagcgaaattattggcaagggttttttgaacagttaatggcatccaaaaaggcgcgttcccattataatgggaacgcgcctttttttgcaggctgccgggcagcctgcaaaatcaggttcacaggaccgtcctatagaggctccggccaatccctgtgttatgccgccgtgttcaggaacgccggggccttcggcgtttcgttgatcttcagcagcgcctgctcatggtagccttcaccgtcgcgtacaagccggcccattacaacatacctctggtcaggattttgtgaataggtgccgtatttataagaacaggtcgaaagcgtcagaattttgtcctcgggcgtaacttctacatcataactgtacatggagcgggcacgcacgtcggcaagcagcgtattcagccgctcatccgtatattcggccaaatggtacggtacaggcgtcatatcagcttcgcagtaaaatacggcgaaaatttcaaatacatgctttccgccaggcgttgtaaaatagatgtacggcgtttttttagcgaattcaacatcatcaaatttgagcagctgtgcaaacttgtccgcttcagggtcgtcctttgtaccaagcggattgcccaggttatggccgtatatgatcgcattctgcggcagatccttgccttcatcgaacaaaacgctctcataatcaagataatagcagccggcatagctgtaattttttttataatcgcggcgtaaatagtattcattgtccgtcgtctgtacaaccggctcgttgatcttagtatccggaacctgaagccagcctatgacatcagaattatccttcactgcctgttcaagctcctttgaaacatccggtattgtggggacatagttgccgccggcatcgtatccgccttcctgcggcacttttgacggctcctttttgccacaggctgcaaacgacgccagcataaccgccgccgcaaagagggctgcggcccttgttctcttgattttaaacaaactggatcagtccttctgcaaaaatatcgttgcagatagtttgtgcagatccttgcagtctaacagacataagccaaaaagaaattggttcatgtggaatctcattcctataagtttttttcagagggctttttatcacggatgcctcatatatttttatagattgcgctgtagtctataaaaatagtacagagcaactatttttgtacatttgccgccctgcggcatacgcaatttaatcaaaatgatcccggaccaggtctggcccggatggtcaattttaaaccgtggtgaagctatgaaaaaagtacagcgttttttaatgaacgcgatgatcatgacagcgacttccttattgatgaacgggatcggcgtatggttcaatgtctatatctccaaccgtctcggcgcacagggcatgggcgtgttccagttgcttatgtcggtttacgcatttgctgtgacgtttgcaacttccggcataagccttgcggctacgcgtctcgtcgcagaagaaacagcacgtcccggcggcagcgccgccgccgcgatgcggcgctgcctgatttatgcgctgaccttcggcggcgcagccgcgctgtttttatatgttggcgcgccggcgattggacgatattgcctggaaagcgttcagaccatccggcctttacgcgcaatggctctaagtatgccttttcttgccatgtcctgcgcgctcggcggctattttacggccgtcggccatgtcgccaaatcggcggcgtcccagattctcgaacagtttttaaaaatcacactgtctatcatcgggcttacatatctgattacggataacctggaatcagcctgtatggctattatgtgggctggcgtcgcagcagaagggctttcatttttgctggcgctcatcctgtatctgtacgatgtgcatcacaggcgggggccggcccggacagccggcctttcacacaggctgcttaaaattgcgctgcccgtcgcaatcagctcttacctgcggtcaggattatccactgtcaaaaatctgcttgttcctttgcggctgcaagcggcagggctcgcacgcggcgacgcatttgcagcatttggcgcggtgcatgggttggcgctgcccgtcatcctgtttcccgccgcgctgcttaattccttttcaagtctgattgtcccagaggttgccgaacgccatgtcagggagcgcagcgtcgcgcatctgattgagcgcatgttctcactcaatctgttttgctcgctcggtatctgcggcgcattgtttgcctttgcaaatgaaatcggaacggcgctctccccaaacccggatgtgggcgtctatatccgcctgcttgcgccggtcattcctattatgtacctggacacagcggtcgactgtatgctcaagggaatggatgaacagttaagcgttatgcgatacaatgtcgttgatgcggcgctcagcatggcgcttgtctacattttgctgccgattatgggtatcaaaggttatattctggttatctgcttaagcgaggtattcaatttttctctcagtcttgggcgtttaatcaaggtaacaaaatttgaactcgatttgacagaacgtgttgtaaagccgattctatgtatcgcaatctctgtgctggcgaccaaaattatgtcccatgcggggcttttttcagatgccaccgtcctgctcggcgcctgcgcgcctgtagcagcggcagcagtactctatctgcttctgacacggctttgcggaattgatccacggcgaatttaaaagctggctttctgctttacagatatgtgcaggtataattgcagatgtctccatcatatccataaagaggaactgctttgagaaaagaaggtgtttgctgatggatgacagggagctgtttgcccgattgatccaatgcgaggcgggaggtgaaggcgataacggtatgcgcgccgtcgcaagcgtcgttatgaatcgtgtaaatgcgccgggcggcgaatataaacgtgttgggcagggcagcattcgcaaaatcctgtaccaaaccggccagtttgtatgtatgtccgaaacagagcgcggtaaatataatccacaaaacatctataacatgcgcccggaacagatccattatgacatagccgattgggcaatcgcaggaaaccgcctgatggatcttggtacagcactctggttttataatcccttttcacccacctgccgcagaaatttcccaagtcaaatcggatatctgatcacacggatcggagatcattgcttttataatccatccgacgcatattttaaaacttaaagagaggtgctgcatacatgccaaataacgaaggttctctcaacatgggaccatatgagccagttcaggaaatcgaggaccctcaaaacaatgaggaggtttatctggggtcttttaattcaatcattcaacacaatttgggcacctatgttgcatgtgaatttttaatcggcaccaataaccttgaacgcagggagggaatcctttacagcggcggcaacaattatgtcacactatatcagccaagcgatgaagcctatatcgtctgtgatcttttttcgctcaaattcctgacattttatgatacacgcaagcggccccgcggcggtatcagcggaattccaaatccgcgcaggtttataaacagcacgccgccggcaaatggtagcggcagcccgcgtacagcatggcagtaatacatatttgaaaagcacggcggcgaccaattggtcgccgccatgcttttaccagctcgtttgctcctgcaaattcgtcttaaataaattgccggttttgccattttccgctcataagacgcacaaaaaatacaactgcccggaacagccagtcgacaagcatcgcgcaccagacgccaagcacaccgagttcaaacatcagacccagcacatagctgaatccaacacgaaatacccacatggagacaatggaaatgatcatggtaaatttaacatcatttgcggcgcgcagaccgtttggaagggcgaatgaagccggccagaaagtaaaattgccgatgcagcagacaagcccaagctgccaagccagcgcagcagtctgcgcagaaacctgaaacatgccgatgatcggacgcatcagcagaataatggaaagattgagcgccagattcatcatataggccgtgccagtcaacgccagcatatagtgcttagcctgcttatactcacgcgcgccgatacattggccgatcaccgtcaccatcgccaggctgattgcggctccaggcatctgcgacatcgtcatgatgctgttgccgaccgcattagccgcaagggctaccgtcccgaaggtcgcgatcaatccctgcaccatgattttaccgacatgaaaaattccgttttcaacaccattgggcacacctatacgcaaaatattgcgtatcataactggatgcggcgagagatcacgcaaattttcgatatgtacgcggttttgcttgtgtgttgtcagtataaaaaggaatgccgccgctgtaaagcgcgcgatcaaggagccaagcgccgcacccgcaacacccatcttcagcccataaatgaaggccgcattgaaggagatattcacaatgttcataatcaatgcggcaaccatcgatatttttgaattgccctgcgcccgaaacaatgcggcgcatccgttataaatcgcaatgagcggatatgaaaccgccgaaattgcaaaatatgtccgagcgttttccataacctccggctcggccgaaccaaacaaagcatccaggagcgggactttccaaaccaaacaggcggccatcaatacaagtgagagcagcgtgacaacgatcacgagctgcttcgccgcaatatttgcgttttcaccgtcctctttccccagatattgtgaaacaacaatcgcgcctccagtcgccagcgcagcaaatacctggagcaaaagtatattgattgtatcgacaagcgatacgccggacatcgccgcctcgcccacgctcgataccataaatgtgtcggccacgccgattgttgcagcaaggatctgctcgataatcaatggaataatcagacgtacaaggtcgcttcttttaaacatatcggcacctctttccaatgattccattttgctctttttgaatataaacttcaagctgcttgcaaaattttgtaatatcatccgttatatccggctattttaatgtaaaatctgtataaattttactgtagacagacaatggaaaaaggcagctccccacatggggaaccgcccttttccattgtctgcaagaatgcagagaaatggagcaaatacgtatggtttattcgtcggacagcgttcagccaacaatttccccgacttcatcgcgtaccgcattttcggtaaactcttcctcactgaactcataatcgtttccggggaagatcgcattgagcaggataccaagaatcgctgcgactgccaaaccgctgagcgtaatggatgcacttgccacatggaatgtaatgccgccgatgctgttaaagccaaggccgctgatcaggataatcgccgcaatcaaaacattgcgcgactccgtaaaatcgacctgattttcaacgacattgcgtacaccgatcgcagaaatcatgccatagaggataaacgaaacgccgccgatggtagcagtcggaatcgtgtgaataaattcgccaaatttcggaacaaagccaaagcagatcgctaccacagccgcaatttccatgatgaccgggtcataaacctttgtcagcgccagaacacccgtgttctcactgtatgtcgtgttggccgggccgccgagcataccggcaatgcttgtcgcaacgccgtcaccaatcagggttctgtgcaggccagggtttgcaaggaaattccggttgcatgtcgcgctgatcgccgcaatatcgccgacatgctccatcatggtcgccagagcaatcggaaccatgataataattgcactgacatcaaattttgcgagggtaatcggtaccataccaattattggggctggtccgacagcggagaaatccacgctgccggtgacaagcgccacaatgtacgaaccgacgataccgagcaggatcgggataattttgatcatgcctttgccgaaaatattcgcggcaacgacaatcacaatcgctactacggcaagcaaccagttcgaactggcgtcattaacagcattcggggcaagaatcaggccaatgagaatgataatcggaccagtgacaaccggcgggaagaaccgcataatccgcttgatgccgcaggtgcggatcagcgctgccagaacaacatataccaaaccggcaatgacgataccgccacacgcatagggcagcttttccgcctctgtgagcgcgtttcccgccgcatcggtgagcggcagagccttgaccgccgcgaaaccgcccaggaaggcaaaggacgaaccaaggaaaacaggcgctttacgctgcgttaccagatggaaaaacagggtgccgatacctgcacagaacagtgtcgtctggacattcagacctgtaatgatcgggacgacaacggttgcgccgaacattgcgaacacatgctgaaaaccaagcacaatggttttaggccagcccagctccttaggggcgttgtaaatccctgcatttttgttggccataaacttacctcctcaatcgtgaaatcttgtctccatttctctatgtatccaagagcctgcgctctgtataccgggcacccaggcgcgggaggccgtcaggcctcctgcgcttttttctccttcagcgctttgagcacgtcgtccgctgtgattggcatccggtagaaccgaacgccaagcgcgtttgcaatcgcgttggcgatcgcaggcgctccggggaccatgaccggttcgccaatgccgcgcgcgccgaatggaccggtcggctccgcgtgctccgcaaccttgacgaccatctccggcatatcgtcggcggtcggaattttataatcgacaaaactcttattgaggaccttgccgtccttaagcttcagctcctcgaacagcgctgttccaagcgcctgtaccatcgcgccttctacctgcgcgtcgtacagcttcggattgataacctttccagggtcaaagcaggaaaccatcttcaacacgcggatctcgccggtttctgtgtcgatttcgacctctgcgccgttgacgcccattgtccagaatgcgacaggctttgttccctgccctgtttcgtgatcgaagcccatattgttcggcacaacgaacgaaccttttccgatcagcgggccgtgaatacccgaagcgtccggcatcgtcaggccaagcgcaaacgtactaatcggcaccttaatttccggatgcatcttatggacgacaaagccatcgcgcaactccaggtcgcgcttcccatagcccatcttgatctgcgccagatcgagaatctcatcacgcgcatcctcggccgccagtttgaccgcgttgcccgcgcagtacgttgtgcgggacgcaaccgtctgccattcatacggcgtatggtcggtatctcccgtgcggattgtgattttggaagggtcgacgctgagcacctcagccgcaatctgagtcagcgccgtgtcggaaccctgcccgatatcctggccgcttgtcatcaggaagaaggtgccgtcctcattcatgcggataattgcagcggaggcaacgtccgtaggcatggacggcgatttccagccgccggcaatcccttttgcgcgcacctttgtcggcgaaggcgaaacggacggcgtgtcgtaatccatttccttaataaccgtctcgaggcaatcctgatatccggaatcctcaagcacctgtcctgttccggtgatgccgccggcacgcaggccgttgatacggcggatctccacctcggaaatgccgatctcatgcgcgaccacatcgaggttctgctccaggccaaaatggatttcgcacatgccgaagcccctgtacgggccgccgaccggatggtttgtataaacgcagtagctgtcagcccatgcgttcgggatatcatatgggccaagcgccgccagcccggctgcctttacaatgttgacgccgtattcggtatacgcgccggcgtcccatatatattcgaccttttccgcaaggattttgccgtccttgcgcacgccggtcttaattttgatatgtacgccctggcggacatacgaatcctcgaattcttcctcgcgcgtataattgagtttgaccggccgcccacagttgagcatggaaagcggaattacgatgccttccagcgtcgtgccggcctttgcgccgaaaccgccgccgacatacggcgaaatgacgcgcaccttgttcagcggcaaatcgaacgacgcggccaaagcctggcgaaccgcaaagggcgattggcagcttgcccaaacggtcagcttgccgtccgcttcatactgagcgaccgcgacgtgcggctcgatcggcacatgctggacatgcggcacataataggtgtgctccgttacatagtcggattcggcgaaacccttctccacatcgcccttgcgcagcttgaaatggtgcgaaatattggtgcctgcgattggatggaagatcggcgcgaccttgtagctaccaagatccggatggataatcggcgcgtcgggcttcataccctcgattgcatttgtaacggcgggcagctcctcatattcaaccttgatcagatcgaccgcctgctgcgcgatctcaagcgtctcagccgcgacagccgcaacagcctcgccgcggaatttggccgtgccgaccgccaggaagtttttatcctccagatagagtccgccgcgctttttatagtattcgccggtgataacgctcttgacgcccggcagcttttcagcctcggaggtgtcgatgctcaaaatcttggcgtgcgcgtacgggctgcgcttgacctgcgcgtacagcatgcgcgccattttcatatcgtcaacatattttgcctggccagttacctttttgattccgtcaacacgatcaatcgatacgcccacgcttttcatttgcgcacacctccttcagtatgttcggccacatcttctatggcctcgataatcttcttgtatccggtgcagcggcacagattcccgctgattccgcgtgcaatttcctcgcgggtcggatgcgggttttcgcgcagcagcgccgtcgccgtcatcaaaaatccgggtgtgcagaagccgcattgaagcgcggcatgcttgacaaacgcctcctgaagcggggacaggttccccttgcggtcagcaagcccctcaacggtcgtaatatgcgcaccgtcaagctcgggggccagcaccaggcaggcgttgaccggcttgccgttcataatcacagtgcatgcgccgcattcgccggcgccgcagccttcctttgcgccggtgagatccagctcctcacgcagcacgttcagcagcgttttattcgcgtcaacataaagctcgaccggctcctcgttgacgaaaaagttcacctgatatttcatcgcttccccctccttatttcgcaagcgtttcaaggcctctgcgaacgatcagcccgacgatgtccatgcggtactccttggaggcgcgcacatcgctgatcggcgcgacctccgagcgggccagctcgaccgcctgttcgatcaaagcggcgtccggctttttgccgcgcacaagttcttctgttttcaccaggcgaagcggcgtcggcgcgactgaaccgaacgcgaagcggaattcgccgccgcagcgcagcacggtcgcgcagacggtggacaggtcgacctcacggcggcgggccacctttgtgaacacgccctcggcgccggctatgtaaggaacgcggatcgccgtgacgatttcaccgggcttcaaggatgtcttgcgcacaaagataaagaaatcacggatggggatctcacgcctgccgtcgggaccttccgccagaatgaccgcgtcgcacgcgagcagcggggtccccgtgtcggccagcggagatgcgttgcagatgttgccgatgcaggtggcgcggttgcgcacctggcgcgaacccaccgacagggccgctttggcgaggaacggatagtgcatgcagaccgcctcgttctcgccgatcgcattcatcgttgcgcaggcgccgatcgtcaggccgttctgttcgtcaaacgaaatgttgtcaagccctgggatacgcttgatatccacaacataatccggtgcgatcagccggtcgcgcagacggacgacgacatcggtcccgccgttaaataaaacggcggattctttgtaatcggcgagcatctgtaacgcttccggcaaggtttttggtgctaaataattaaattgcttcacgatcagcactcctttttatgcagattgtcgcttaccactgtaatcattatacagtcgccccccgatgaaagcaatcatttgcagccattttttctgtaatgcctagaaatatccttattctttatgcagttttgattacaccacgctgtaaaatattcacaataaaaatcacaaacccgcatccttttttgtaaaaggagcttttatgcagaaagccttttgttatttcacaatgcagcgaacaaatgtcagttcaattaaaaaccacaaatcaaagattcctattatttactttttttaaattgaattgtgcaatatgcattaatttttataatttaatctgttatacaaagtcgctttatctagtttacaattccaaatttatgaactataatgtatatacataacaaaccagcggcgtacacttttcaggggcgggatttcaatgcttcaagaaggattgccgcgtttttgcattttggagcaatttttttatatgcaaatgaatatttttattttgtagatatatcacaacaacagctattttttgcaggtattatctccacttttaccctacccatattgttataatatcataatttgcaatagaacacaactgcaatccgctatattttacgattttttagagttccttatatttatgtcgctgatgattctgtaaataagaacattgtaaaccggctgtatcgagaggagggagacatggagttttaaggctgagaaaggataagcctttctcagccattccactgtggaatggctgggttctgtttgtcagcctggagagagacccatcagtatgcttctcttattcaggcaatccaaacactgaagtgaaaagaggcttatcagttatgagtgtagaattaatatccctgttttttttagttctagcgattgccctagggtattttacaagagtaaatactggaatactggggatcgctcttgcttttgtattgggaacatttgtagcgcctttcagcgtcatgaccgaaaattcggccataagcggaaatgaaatcatcggcggattccccacaaatacatttgtaacgcttatgggtatgacctttctgttcagcatcgccaaggctaatgggactctggaaacgctggcgatgaagatcgtccgccttgccggcgggaggacaaggattatcccctttgtgttcttcgcgttttccattgtcatgtcggctgttggcgctggaccgatcgtcacgccggcccttatgtgtcccattgcctgttctgttgccagcaaggaagatatcccggatattgtcgtgcttgtctgcgtcatctgcggcgggcttataggcgggactaccccatacggccccacgggcgttgtggcttccagcctgatcgttggcgaagcggggctgaattacctgcccacgctggcagcaaccgcagcggttcaccttgtgcagttcgccgtgctttatgtgatggtcggcggtttcaaaattaaagtttcccactcgtctgccagcgaggtggaggcaatccctttcacgcagaatcattacatgaccctggctgcgatcatcctggtcgttctgggcacaatgatcttgaactataatgtcgcgctgctggcctttttatttggggcaattctgctccttctgaaagctgccagccagaaagacgtcattgccggtatcccctgggggacgctgcttctggtcggcggcatgacggtgttgattgtcgttatcagggaactgggcgggatagacatgctttcggattttctcgccgggtttatgacggagagtacggcatgttcgttccttggccttatggccggtatcctgtcagccgtatccagcgcctccggcgtcgtgatgccgacgctgatccctacggtcattgatttatcaaaagaactgggcggagcaattgacccggcggcgttggccgcggcggttgtcgtgggcgcggaggtcgtaacggtttctcccctttccacgatcggcgctctggggtacagcgccgccaacgaaaaaactgacaaaaacaagctttttaccactatgctgctgtgcgccggcgtgtctttggctgttctttttgtattaggatttctgggggtgtttaactggtttttgtaaagacccgtatgggcttcggcgcatcctcaaggttttggcatccccctctgcacatggcaaaatcggattttattatcctttattttatatgcatctttgacaatatcaaattgtaaacataattggaatcatcagtcacacacaatcgtacacattaaatttagaaacgggaggaaaaacaacatggcaaagccactcgacggaatcaaggttctcgatatgacaaaggtcctggcgggaccgtactgcggcatgatgctgcgcaacctcggcgccgaggtcatccactgcgagatgcccggcgccggcgacgatgcgcgcgcctacgggccgtatgtcaacggcgaaagcatctactttttgagcatcaaccgcggcaaaaagagcgtcgagatcaacgccaagacgcccgagggcaaaaaggtcctgactgatctcatcaaaaaagtagacgtgtacgtgcagaacttcaagcccggcgcgcttgacaagatgggctttggttatgaggacgtcaaaaagatcaacccgcgctgcgtttatgttgcaatctccggcttcggacagaccggcccgtatgccaaccggcccgcttacgatatgatcgtgcaggccatgggcggcgtcatgagcatcaccggcgagccggacggcaatcccgtgcgtgtcggcacctcgatcggcgatatcatcgccggcatgatgggcgcgtatggcgcgctggccgccctgtatgagcgccagacgaccggcgtcggccagcttgtcgatatctccatgctcgactgccaggtcgccatcctcgaaaacgccatcgccaaatattccgcgaccggccaggtggcgcgtccgctcggactcaagcatccgtcgatcacgccgttcgaagcgtaccgcaccaaggacagttgggtcatcgtcgcggccggaaacaacaaactgttcgccaagttctgcgaggtcaccggccgtcaggagctgattgacgatccgaagttctcgacgaaccccgagcgtaataagaatatgcatgagctgtccaacctcatgcaggagaaaatcaaggataagacgaccgacgagtggcttaaaatctttgttgacaacggcatcccctgcggcccgatcaactcaattgaccggctgttcgaggacccgcagatcaattaccgcaatatgcttgtcgaggtcgagcaaccgcacatgggcaaggtccgcgtggcgggaaacccggttaagctgagcaccgttcccgccgaggatgagctgccgcatgagcctgctccgcaggttggcgagcacaatgtcgaaattctgcgcgacgtgcttgggtacagcgacgacgagatcaaggcttacatagacacccttccaaaaaaggagtgagcatatatggaggaaagatgcgcatcgcacgaccgtccgttcgtgctggaggaaacgaccatcgccgccatccacgaggcaatgctcgacggcaggctctcctgccgccggctggtcgaaggctatcttgcccgcattgaagcgtatgacaaaaagggaccgaacctcaatgcgatcatccttgtaaacccacacgcgctcgaggaggcagaccggctcgacgcgcgtatggagcaggacggcctgaccggtcccctgcacgggatccccatccttttgaaggacaacgttgaaacttatgatatgccgacgaccgccggttccctctcgcttgaaaatttcgagacgcataaggacgcctggattgtcaaaaaaatgcgcgaggcgggcgcggtcatcctcgccaaaacgaatttacatgaattcgcggtctggggcgagacagtcagctcgatcctcggccagacatacaacccctacgaccacacccgcacccccggcggctcgtcgggcgggacgggggccggtctggccgccaacttcggcgtcgccggaatcgggacggacacaatcaactcgatccgttcgccgtcgtcggccaattccctcgtcggcatccgtccaacaatcgggcttgtcagccgcgacggcatcgtcccctattcgcttacacaggatacggccggcccgctcgcgcgcaccgtcgccgacgccgcgcgcgtgctcgacgtgatcgccggctgcgaccccaaggacccagtcacggaaagttgcatcgggcgcgttccgccaagctatctcgactcgctcaacgacgacggcctgcgcggcaggcgcatcggggtgctgcgcagcttcttcggcacgaaggacatccaccgcgatgtaaacgccgcgatggagcactgccttgacatcatgcgcgaaaacggcgccgaggtcgtcgatatcgaggagacaatcgattctggttatcttgtcaaaaatgtaagcgtacatatccatgatctgaaaacgcatctcggccaataccttgcggccttcggcgacgccgcgcccgtccattcgctcgccgatgtgctcgccagtgggaaataccatccgggcctcaaaagcaacctggacgaagcaatgggctacgacgtgggtacgcccgcatacaacgaacgcctgcgccagcgcgccgagctgcaaaagcagatccttgcgatcatggacaaataccaggttgacgcgattgtttacccgcatcaaaagcagcttgtctgcaaggtcggcaaaagccaggaggagcgcaacggcgtcatcggttcggtgtccggttatccggccattgtcgtccccgccggcttttccgagccgtccgacgacgcgcccatcggcgttccgatcggcatggagatgctcggccgcccgtttacggagccgacgctcatcgaaatcgcctacggctttgagcagcacagtcatctgcgccgtccgccggtttccacacccgcgctcaacagataaaccgtttggagggattacatatgaacaaaatagaggaccttgtcgcccgaaaaacagccatttaccaaggcaacgccaaggcgattgaaaagcagcattccagtggcaagctgacggcgcgcgagcgcctgggcctgctgttcgatcccggcacctttgtcgaaatggatacctttgtcacccaccgctgcacctatttcgacatgccttcaaagcattccccgaccgacggcgtcgtctgcggctacggcaaggttgacgggcgcatcgtattttcgtatgcgcaggacttcacgatcatgggcggttcgctcggcgagatgcaggcgaacaagatctgccatgtgctcgaatcagccgcaaaggtcggcgcgcctgtcgtcggcatgaacgactccggcggcgcgcgtatccaggagggcatcgacggcctgtccggttacggcaaaatcttcttccgcaacacggcggcttccggcgtcatcccgcagatcacggccatcatgggtccgtgcgccggcggcgcggtctactcccctgccctgaccgattttgtgttcatggttgatcagacgagcaaaatgttcatcaccggcccggatgtcatcaagaccgtcaccggggaggttgtcaccggggaggcgctcggcggcgcgaccacgcacaacaagacgagcggcgtcgcgcacttcatggccaagagcgatcaggaatgtatccaacagatcaagcgcctgctttcgtttttgccctccaactggaaggagcagccgcccgaggtcgacctcggcgacaatccgtaccgtctcgtgcccgagcttgcctctatcctgccggacaacgcgaaccgcgcttacaatatgtacgatgtgatccgcggcattgtcgacggcggcgactaccttgacagccaaccgctttttgcgacgaatatgatcacctgcttcgcgcgcatcaacaagcgcgccgtcggcatcatcgccaatcagccgcgcgtcggcgcaggctgtctcgacatcaacgcgtccgacaaggcggcgcgtttcatccgcttctgcgacgcgttcggtctgccggtcatcacgctcgtcgacgtgcccggatttttgcccggcacgcaccaggaatacggcggcatcatccgccatggagcgaaaatgctctacgcttacagcgaagccactgtgccgaaaattacgctgatcctgcgcaaggcgtatggcggcgcttatctggcgatgtgctgccgcgagcttggagcggacgtctcgttcgcatggcccgacgccgaaattgccgtcatgggccccgagggagccgccaatatcatcttccgcaaggaaacgcctgagcaacgcgcgcaatcgatcgcacaatataaggccgaatttgcgacgccctataaagcggccgagcacgcatttgttgacgacgtgattcatcccgctgaatcaaggcagaaaatcgtcgccgcgcttgaaatgctgcacacgaaggaacaatccattccgaaaaaacgtcacggaaacattccgctctaacagatgctttgccgcccgccgcagaaccgggtgggcggcaaagcaaatgcatgtgtaatatgcatatataattttttgatttcacggcaccgattgtttgatttattgtgaaaattgtattattggtctattttttacacgatttatttaatatttttatgcaaaacattcatgacaaagtaaatcaaaacaaagtgaaaaattttatattatgtattttacacaatgtctattgatttcctaattatttgtagtatgatggaatcaatgacagggccagacagcttccaggcgaatcggaattgtggcgtacagcgccatccgtcagggaggtttctaaatggaaaaaacatatggcatttctgtcagatcggtgctcgacatggaagtgctcaagggcgccaagctgtttgccgggcgcggcggcctggaccggattgttacatcgatgaatgtcatggtggaaacgccggatatcgtcaaatgggtttcgccgggcgatctgcttgtcaccaccgcttattcgatacgggatgatgtcaagcggctggccagcctcgttcctgtgctgaacgcgcatggtgttgtggggcttggcatcaagccgaaggaatttattcccgaaatgccgcgcgaggttatcgaagcggcaaacgcgctctcatttccgatctttgagataccggcagaattatcattttctaaaattattacgcccgtgctcactacgatcctgaacaatcaggcgcaggtgctcatggacatttatgacctgcaaaaatcgctgaccgccaccatgttaagcggcggcaatttgcaggccatcacgcaaacgctgcataaccgctatggcaacagcgtcgcgatctacaacgaatttttctcctcctatgttatctctgccgccttcagccgccgggacgcgatttaccgccagatggaaaactgcgtgcgcggcagcggcatgaacgatctcgcggctgatttttcaaacacattgagccgccgcgaacggtgtatggtcgacggaaaggaatgcacgaagattaccgttccaatttacagcgataaaaagctgtatggatacatcttcatgtgggaggataaccgggaaatcaccagcgtcgatcttgctgtcatcgaggcttccacctccctgatcgcgctcgacatgattaaaaaaatctccatctttgaaatggagaacaaccacaaggtcagctttctcgacgatctgctcgttaacgacgatctgtcccagcgccgggcgctcgcaaatgcggaatattttgattttgatatcgaggcggtccatcaggtcgcggttgtccaagtctgcaacacgaacaactccctttcgctctccaacggagcgctatacaaaatgaacaacagcattgtgcgcgtgctgcgccgcctttccaggaacgcagcctgcaagcttttgttcgtcaacaagtgtgacaatatcgtccttgtatttgaaaacaagctgcgttccactgacctctgtaaacaggaggttacacagtttatggagacgttgtgcggtgccctgcgcggcgacagtctcctggagttcatctgcatcggcgtgggtcgtgcctatcgagaagcggccgatctctggaaaagcctcgccgaagcaaagcgcgccgcttcatgcggccccatcgaccgtgaacatgcgctctgttatgaggatttgggcgtttaccgttttttatcgtatgagaatcttcagccggagcttctgtccttttacacagaaacgctcaaggtgctcgtggattatgaccgcgagcatgactccgagctggtccacacgctgtcgctttactttaaatgcaacggcaacctcaagcgtctcgcggaggagcttggcgtccattacaacactgtggcttaccgcatccagcgcatcaaggaactggcgggcgtcagctttgacaattccgatcagcttttaaatctgcaaatcgccttaaagatccatgagatacataaaacaagataagcttctgcgcgcggcggagctgtgcagccatctgcggcagacgcttgacaaaggtttcctttccggccgcgtgctctccgtattcgatcacgccgtaaatcttcaaacaccggccgggcttgtgtccctgctcaccgcgaaccgggcgctctaccccgattccatccggctgctcgaacacgggccgtttagcgcctgcgggcttcggcccggtatccgggttgaactggatgccaaatgttgttttttcccgaaaattgatttgacgattgatttgcaggacgctttggtgaaagacctctcgattttccacgtacccggcctgattgtaccggacggattgtataaacggctctcccatatcgtcgaagcggccgcgcggcgcggtacggccgaaggcttggccccgctccttttttccgtggggcgccgccccgaccgggatcgtttcccgcccaactgctatacaagcttcctttggccccggtttgaaacgctgttcacagcgatccgatccggcgatttggaggcggcggccgccgcggccgcgcagatggccggctgcggcccgggcctgacgccgtcgtctgacgatttcctgaccgggttcatggccgcgcttctcacgcggtcggctgcggatcaccatacacagccggttctggcgttaacaagacgaatggcggatgcggcttgtcccaaaacaaacgccattagcggcgggtttcttgcgcagagcgcccaagggcttttctctgaagatgtgatttccaccatgaccgccctcttttcagaaggcgatccgcaggccctgtccgacgcggcttataaagtcgcctgctttggtgaaacctccggaacggatattctaaccggtatctatttcggcgcaaaaatataatacaattggaggaatcgtcattggtcaagctggatattaagccgaatacctattacgactcggttacgctcatgatcatctccaaggatctcaaaaagctcgatggtgttgaagaagcactcgtcggcatgggtaccgatctgaaccgtgagctggcgcacaacctgggcatcaattcgcccgaatttgagacggtcacacccaacgacttctttgttgcagttaagtgcgacagcgacgaagttatggccgccgcgctcgccaaggtcgaggaaatgctcaacaagaaaaaagaaaacagcgccatgaactactatccgccgacgctgtcctccgctctcaagatggatgaccagctcaatatggccgtcatctctgttcccggcaaatatgcagccgaggttgcgcagagctgccttgacaaggacatcaatgtgatgctgttcagcgacaatgtcacgattgacgaggaaaaacgcctcaaggagtgcgccgcctccaaagggcttctgatgatgggacccgactgcggcaccgcgattatcaacaacgtcccgctggcgtttgccaacgtggtcaaaccaggcgatatcggcatcgtcggcgcttcaggaaccggtacgcaggaggtttcctctctgatcgaccagttcggcggcggctgctcccaggttctcggcaccggcgggcgcgatctcaagctcgaaatcggcggcattatgatgacgctcggactcgacgcgctgatcaacgaccccatgaccaaggtcatcacactgatttccaagccgccggcagaggaaatcgcggataaaatcctcaagcaggctgccggcgcgggcaaacctgttgttgtctgtttcatcggcggcgatcccgcacaggttgaaaagtacggcctgacagccgcctgctctcttgaggacgcggcccgcaaggctgtggcgttttcaaaaggtgaaaagccggttgatttcaccgggttcaccgcgccggaagctgagatcgataaattggcggccgatgaagctgcaaaatttgcttctacacagaagtatatccgcggactgtacacaggcggaacgctgtgcgacgaatcgatgaagctgcttaccaaggacctgggcggcatccattcgaatatcccgttgtcgccggagtttaagcttgccgacgtcaacaagagcgtcgagaacacctgtcttgattatggcgacgacgacttcacgcgcgggcgcccgcatccgatgatcgatccgtccctgcgcgccgagcgtgtcgtggccgaaagcctcgatccgtcgacggccgttatccttgcagactgcgtgatcggctacggctcccaccccaacccggccgaggatctctgcgacgcgatcaaaaaggcaaaggccaacgccgagaaggacggccgctacatcagcgccgttgtagctgtctgcggaactgaaggcgacccgcaatgcctgtccaagacgcagcagcagcttcgcgaagcaggtgcgattgtcatgccgtccaatgcgcaggccgcacgcttctccgagaagattctcgccaacatcaagtaggaggtggatacaatgagcaaagtcaacgatctgttccagaagaagctgcacattgttaattttggcatcgagtcgttctacgaggatctcaagagccagaagcaggaagccatccacgtcgactggaaacctgtcgcgggcggaaacaagaagatggcgtcgctgctcggtatgctcaagtaatttgggaatcagaaacgcttcataacatacattcaaacatgaacgggaggaatttacaatgacgcttggcgaaaagatcaatcaggctaacgctgaagctcttaaacgcatcctcggcgcacagccgacgcttgtcggtatgggaaccgccggcgaggacatccccggtatgaccaagaaaaccatcctgcatgccggtccgccggtcacatgggacaaaatgtgcggcccggtgcgcggcgcgatcatcggcggcctgatttacgaagggcttgcctccaataaagaggaggccgaaaagctggcggcttccggggagatcaccttcgattcctgccatcatcataacgcagtcggcccgatggccggtatcgttacatattccatgccggtttggaaggttgtcaataaaacatacggcaactatgcctactgcaccttcaacgaggggcttggcaaggttcttcgcttcggcgcgttcggcgacgaggtcattacccgcctgaaatggctccagaacacactgtatccaatcattaaagaggccttggagattcacggtgagatcaatctcaaaacaatgatcgcacaggtgcttcagatgggtgatgaaggccacaaccgcaataaagccggtacgtcgttgctcatccgcgagattgccccggcgattgtcgcgacacatttctcgcaggaggagaaaatcgaggcgcttaaattcctcaacagcaacgaccacaccttcctgaacctgacaatgcccgcctgtaagtccacaatggatccggtcggcaatattccgtacagcaccatcgtctacacgatggcccgcaacggcacagagttcggtatccgcgtctccggccttggcaaccgttggttcactgccccggcggagatcatcgacggactttacttccctggcttcacctcagcggacgccaacccggatgtcggcgatagctgcatcacagaaaccaccggcatcggcggcttctgcatggcggcagcccccgcgatcgtccagttcgtcggcggcaccgtggccgattccatcaaatattccacccagatgtacgagattaccgagggtgagggcaacacctatcagatcccggcgctcaacttccgcggcagcgccaccggcatcgacatccgcaaggttattgaaaccggcatccgcccgatcatcaacaccggcatcgccgccaaagaaatgggcgtcggtcaggtcggcgccggccttgtcagcccgccgatgaagtgctttgaggacgcgctggaagcttgcgccgcctgggcacaggaagcctgattttctcctcgccgcttagagcggcacagcaatctgtcggaccgtattttatatacataatttgaaggaggcattctcatgagcaagtggagcgacattaaaatgtacgacctgagcatcccgatcggtatcctgaccccgccgtggccgacctatgagccgatgcagatgaaattcttcaaacgccttgcgcccaacggtgccaacggccagttggttacgcattccaaccatgtcggcacgcatctggacggccctctgcatttcgacaccgccggccgtgatatcgcgtccctcgagctgacaaagctgtgtgctccgggcgtcgtggttgatatctccgatatgggccaggatttcggtatctacacgccgaaggatctgatggaccgcgctgaaatccgcaaaggcgacatcctgatcatcaacaccggttatcacaaatacggctttgaccagccgactgctgatgagcgccgctatatgttgcgccatcctggcccgtcaatggactttgtacaatggatccgcgatatggaaatcaagtggatcggcgtcgactgcggctccgccgaccatccgatgaacacaaagatccgtgattgggagccgatggaggctgaagcctgcgacaagatcttcatggagcgttacggcaaacacctcaatgagatttatgagtggccgaagaactatcaggccatgcatatccagttgttctgccagccgtatgaggcgatccacgcggagtgcttgggcggcgaaattgacaagttgagcaaccaacgctgcgttatcggctgtttcccctggaaattcacagagggcgagagctgcatcagccgtattgttgccttcaccggcttcgaggacgcgtaaaaatctgcattccccatattgtccatatagagaaacatcttcctcacacatgggaaggccgcctgcattcgtgcgggcggcttttccatttcaaagtacaaaacttctttgctttcgacaaaaaacatggtatactgaacctatgaacaatccaaatggaacgtgtataaaagaaaggggcagattcatgcgatacgaaattcagggcgagccgcttccggttgttgtctgtgaattgcagccaggtgaaaaaatgatcaccgagcgcggctccatgagctggatgacatcaaacatgcagatggaaacgacctcaaacggcggcgtgggcaaggcgcttggacgtatgttttctggcgaggctctgttccagaatatttacactgcggtgggcagttccggcatcattgcgtttgcttccagtttccccggctccatccgtgcggttgagatatcgccaaataacgaattgattgttcaaaaatcgggatttctggcctctgagtcaggcgtcgagctttcgatctttttccagaaaaagctcggttccggcttcttcggcggcgagggctttattatgcagcgcctgtccggcaaagggatggcttttgtagaaattgatggttacgctgtagaatatgaccttgatcccggtgaaaagctcgtggttgatacaggctatctcgctgcgatgagcggctcgtgttccatcgatatccagactgtcccaggaattaaaaacaagctgtttggcggagaaggattttttaacacagttgtcactggtccgggcaaggtcattttacagactatgcccatcagtacagtggctggcgctttgcgccccttcttccctactacaaaataaattgagaaaaccaaaaagaaagccttcagcgcatcatcgctgagggctttcttcccattgtattacaatcgaaccggctgttaaggcggcaacaggctgcgcccgcataatgcccagtccatcttggtgattaaatcaacgcaaaacgtttatttgatcacattctgaggttttcctgcgagccatttttccaggttgtcgcatacgatcaccgcgcgcttatacagcgcctcctttgttgcaaatgcaacatgaggcgtcgcaatcagattcggcgcatagaacaacggatgctccggatcgatcggcggttcgatctcaaaaacatcgacgcctgcgcccgcgatcacgccttccttaagcgcctgtgcaagcgcctgactgtcaacaacaggacctcgcgccgtattgatcagcacagcattcggcttcatcagttttaattggtcatatccgatcaatccgcgggtcgcatctgtaagcgggacatgcagagaaacgatatcgctgtttgccaacaactcctccattgaaacataggtcaaccctgattcaggcttttttgtacggctgtatgccagcacctcacatccaaacgcctgtgcaatctttgccacgcgcataccgatggctccggttcccacaacgccgaattttttcccctcaagctcataaccaaccagaccatcctttgtaccgcaggtacgcactacacggtcacatgaaaggatgttgcgatatagcgcaattaaaagtccgaacaccaagtccgctactgcggccgttgaataaccggcgcagttgcagacagtaatcccccgctcacggcaggcgtccattgcgacatggtctacacccgtaaacgcgaccaaaatcaatttcagggaatcgcactgttcgatcacctcccgcttaaaaggcaggttggagagaattacgatgtccgcgtcgcggctgcgctctacaagtacggcgctatccaatatgcgcgtatcataatatgcaatctccagattcccgcccccagcgcgctcgcacattttgagcagcttatctttctcaacgccaagcggttcgaggatcgataatttcataaaaacagcctcctattttgtcgatacgtgatctcatttcaatatagcacatttttcctgaaattgcacgatctttttgacgaaggcttatcaactgaagattgtaatattaattgcgaaaggaaagcgcgacaaaaagcgcggcctttcgcaattttttgtttacctctggcgcgcgataaagaacgaaaccttggttaaaaatggtatccgcgccagaaaaacactaagacgaggggagggtgcaacaatggctggaaagtgtccgtgctgcatgtgtaataatgcacgagtagatgacaaactgacggaagatgataatctttcatatttagcagttgaagaatctgtgaggccattccgaattctgttcgcatcaggctgtggtgagcctttcaggcttttggttcaatttttaattgatggacagtggtctgcagcagcggtttattacccgaggtactgccccaattgcggcagagagcttttggagtatggccccggcgcatgattttagatgaagcttagatagaagatgatgcccgcgccgggctgccctgtccttatcaatcaagcgggaggtgtgtcatttgtgggtttatacatatgctcacgcaacaagcgcaaccggttgacggcaggccgcctttatgaaggcagtattgcctattacggccgcacgccgtatctgtactgcacagacgattccgggaaacagcgcatttatcccgaggcttattttgtggaagcaggtgtttcatttgccgggaaagcccaaacgcatacacaatccaaacaccgccgggcgcggacaagccgcggctgcgcccctcagcgcgcctcatgggacaggggcgggccgcccctatcccatgcacccaaccctggggcaggcgcagcctgcataaacgcagcacccgccctactgttcacggcgcagcctgtataaacgcagcgcccgccccactgtttgcggcgcagccgactaaagttttttgccgaggctttttttcaaaaaagccggaaagttttttgccgaggcttttttttcaaaaaagcggggactgaaaacgcagcgcggcaatctgttcgtttgtggggattgacgggatggcgccgcgcccggcggcgcaaagcgagccggccgcatttgcaaaatcgagcgcgtcggcaagggcctggctgtccccttccaggcaggacggctgatcaagaaggcggcagagcagcgccccccagaaggtgtcgcctgctccggttgtgtcgataaccgttgtctgataggtcggatatgcgcccgtttggccgccgcagcggtaaaaacagccacgcggcccgagcgttacaacaatcagcttcattgcgccgcaaaagagcttttttgtcccctcctccggatccgcggttccggagagcagttccagttcctcctccgacagcttgaggatatttgtatagggtaagccaagtttcatgccggcaattccctgttctgtgctgttccaaagcgcagggcgccaattcggatcataggaaacaagcttgccgtgttcaaatgcataccgtgctgcgtcaagcgtggtggaacacgccggttcagcggacagggataccgacccaaaatgaaaaatccggcatctgtcaatcaaagcatggtcaattgcgtctgtttctatgcactgatccgcgccgggcttgcgcgcgaagctgaaggaacggtcccccgccgcattgagatggacaaaggccagcgttgtaaacgcatcctctttcacctggattccagatgggtcgatccccaatccttcgatgacctctgtcagcgctcggccaaactgatcgctgccaacggcgctgatcagcgccgcctttttcccaagccgtgtgacagccgccaatacattggcgggcgcgccgccaggattctgttcaaataaagggttgccctgctgtgaccggccggccggtgtaaaatcgattaaaagctctccaagcgccgtgacgtcgatcattatattcacctcgtccttttattttttccagtttaccatagtcttttcaggaaagcaaacatggcgcgagcaatccgtgcgtcacgcgcgccaagagaccttttttcaaaaaaagcgggaaaattgcgtttttacgcaaatttggggctgtgcggcggtatgggtaaaggggtgtttgacagatgacaaaacagatgacaaaccggctgaaatttgatatgataaaggtattacaaaatggccggcatggcgctttgctcctgctgcccacgcaagaggtgatttatatggcgaatgcgggtatgaaaccggccgcgcccgctgattacacaagcgcgctttcagagctgctgccgcaactgattgaaaagtattcgcgtgaggctgtcggggattatatgaatgaatgcagcgccaagcttgcgcgcgttcaggaaagcaacgcaagcctgcttgacgttggttcagatgaagccgcgcagtcagacgcggttaaacgcgtcgttgaagcgacgggcgattattatgcgtttttggcaaagctccccgaggatatgcgccgctttttaattttgatgggcggcgttacagccgacgaaatcgacggcttgcttgaaattgaaccggatgtacgtgaagaaatcagtctgctggcttccgtcgcgcctgcaattcaagcgatccggcccaaaaattacattatgccgatcgacccgatcacaaacaaattggcgcagctcaaggaatttaatgagattacagtcgcgcgccggaaaaatctgacgattcagacggccgtcaccatcgacagcccggaacatatgcgtatcgatggcaattttcagcttaccaactacgataaaagcattatcaacggcatcgtatccattttggaaagtggcaactccagctttacggttccgatgctttaccatgcgatgactggaaaggaaaacccaaccgttgacgacggacttgtcgaggagatcaaggcaaagcttgacgcgatgcgccgcctttcgatcaatatcgatctgacagaggagatcaaagcgcatatgatccgccgcaatattgacggcgttgacggcgtcgattcctttacaatcgacggctatcttttgccgctcaataaatatacaggcgtggtcaacgggaagcgcagcgaaatgtatcagattatcgacacgccgccgctttacagctatgccaagctgaaaaatcagattacaaccctgccgattgatctgcttaaagcgccgctgaacaacaatgcgacgaccattcccttaaaaacataccttctcagccgtattgaaggcatgaaaaaccaaaacaaccgtctgacacgcgacaagattttatttgaatcgatctatcgggagcttggggaccttgaatcggacaagaagcgcaaaaaacgtatccgtgattatacagagatcattttgacgcattttatcagcatgggctatatcacgcggtatgagatcatcaaagagggccgcaccatcacaggggtacgcatccactggaaagataaggaacaataaaaagcgcagacagagggggcggcgaattttcgccgccccctctgtctgcgctttattcggtttaagatcacgaccgcacaagcatctgacgcacagaaccatttaatatcgtcgtatacggcacgagcagcaagcggttggacgaaagcagaaacatataatagtaaaaacagccggccataaaaagccccatcgctgtataataaaccgcacgttctccgcgtagctgtgcacgcagcctcccaagcctggaaagctgttgttttttttgctgcttgtcaagcgtttgcagctctgcataattgctttcatcgggcttgatgctgtaaagcatttccggaagcagaaacgttgccacgggcaaaaataccagccctacacgctggaaaataaaatgtttgagcgtcaggataaacaggatggatgcatagacataaagatttaaaagcacgatgttttgggggtctcgcgccaatacacgctttttcatcaacagtgcaacgaccagaaataccaggatcattaacgcggtgtcaaagctgcgcccccatgtgtaataagaaccgggcgtatatgctttaaagacatactgcgtaacaaatcccaaaatgggtacagaaaagatcagtacaaaaagtgttcctgcggcatagaacgatatacttttccagttcagcgggatcaccgcaaggaaatatacaggaaccatcagccaaaggcttttatgaaaagacgccgcaatcacaataataaccatataaggaaggatttttcgatccttcagatatggcaatgcaaacagcataatggaaatcgcaagctcctgacgcagcgtacacatcgaataaccaaagaaaccaaagctgatgtaaacaaaaacgctgaaccagacagagcacgactgtttataaatggtgatggcgcgcgggataataattaatacgggaatcaatcccatatagatggccgcgtcctttgtaacaagagaaaaaagatatgtcaaaaggctgaaacccggttcaaaccggtaaacattactgggggaaaacaggaacgaaaaagggttttggctgaccgtctcaaaataagcctgataggttggataatcgacgccgaccgttgaggaacgcagcagcaccatcatacacataacagcggtcatcgcatataaataccaaagatctgcggtgcgcgacggtttccattcacaaagcagcaatccgccggcgccggcagccgccaacaaaacaatatatggtaacaatccgcatcctccattcattgaatcatccatttccggacatgctttcaagatttgtaaaaacctgatcctggcccctgtttacgggatttctccggcaaatgaccgggcaaaaccaaaaacctgtataaagccctcatgtatacggcctgaaaatgaaatcgccacagctattttttcctgattgtgatgaaaaaatcacaaaccttgaaaccatgcccgcaagaaaaatgttcgctccctctctacacgcggggcgcgcagagagggagcgaacccaatcgtcacatgcgcaagcggaatttccgcttgcatatgtgcattattcgccgagacagcttcttatttgctggtcaggggcgcgtcagtgatgatgaggctgccgccaaacggagccgtcacatgcgcgtaaccattgacatcaacaaagaagttcggagccgcaacgcgtgtataaacgttggtagccctgtcgtaggagtaaacgacgatcgtgtcggtattcagcgcggaaagatccagcttggcgcagaactcggcgttcacaccggccagcgggcttgcctcaccataggaaacaacgacgatatcgtttgtgaaatacttgttgaacctgtcaagcacgctcttaacagccttgtcggtcacatcataggaaaccgtcgtgttgacagtctcggtaacgtttgccagatcagccggatcaagtgtgatgcgggtgatgaccttaccattgacaaccttgtcgatgttgatcgtcaggttgacatcgacgccggacttcgcttcagcagcggcaaccgcatcgttaatagccttgatggccgcaggagacaggctgttcacattgttgaaggtaacagaagcgttcgcactgctctggccggctgcctgcgcgtcagcgatcgccttggtggccgcatcagaggcagcttttgaagccgcagccgcgctcaacgttttagccgcaccggtattggtcttgtcgctgacgatcccgagcttggagccggaggacgaaccgccgccaccaccgttgccgccgctgataataccgctgtcctggggattaccgctgtcctgattaccgctgtcctgcgaatcctgtacagcagggctgatgccttccgctgcgctgaccatgaccgcgcagctaaacagcatgcagacagccaggataagcgccaatgcttttttcattgttgatacactctcctcttttccgattttggaatcgaaatagattttttatgtcatcaccttccacgggcgatatgacatcattgtaatatgcagactcccggacgcacacaagccaacaaggtcaaatggatgagcgtctgttttttgtgcctgtccatttcccctattggtatatttttcattatctcattctaggttttcaatcgcttcttgtcaagcaattttcggcacatatcgagcatatgggcgtataatcgggtgcgtatattcatagaagttttggaggaaatgacaatttcattatgaagctcctacaaggccgggtaaaatgggcggaccggcccgcaggccggtccgtccgtggctggagattatatcaatgaaaggggatgtttattttgtgctgacacgttcattcgacaaaatgtaagttgtcagcgtccttgtttgaagttcaaatgtatcatcatcttcattatacgtaaccgtgcgtgtgatatcacgcagctttcccttgctgtccgccgtataaatatagacatcgtccgggtcgatatcgctgtcaaacggattgttgagcgccagcgttgcccggccgctggcagggattgttgcggctgtaaatttgcggatcactgcatccgtgttgtggaatttcgaacttaaagagctgggccattttgtcgacatggccgcataaaatttggaagggttgctgttcgctttataggtcagcgttgcatacgtgtcgctgccttcaaaaacaacctcgttggttacatttttttccgggcgaatagtaacgcccttgttgccgacggttacgctcgcgctatcgccgtcctcctcttgatttccgacatacagggttccggtcagcgtcaatttatcgccggatttaccattaaaaaactgtgtgtagcgtgtcacgccgttttccgtcacttcgtcgttttttgtgtcggtgcgctttccataacagagcacagccggcttgcgcgcggtaaatgtcacagaaaattcgatcttctgttcatccacgcccgtcatgtcgttgagctccagcgcaatatagctgttgcgctgattcgtataaaactgagcgtaatcattgcttgtgggattctgttgattggggacataaattgtatttttagaggaatttgtcagctttttttcaacaaccttgatcgatttgatcagcttggagtttttttcctttcttgtggaaatacgcacatcctttgatgaatccgcccaatcggcaagcgtcacgggcagggtaaaatacaccgtttgtcccggctgggccgtatccccgatggaaaattgcccgccgtcttcattcagcggatttccagtaatattcgtaatttgataggtgcgcgcgccctgatcgatggcaaacgccggcatttgaagcgacaggacagccgcagccgacaaaatacctgcaagtatttttttcatgatgctttctcccttttttcttgatgggtctggatacgccctctgtataaagagtgcgtttatatggaagaattactgcatattattttccttttttatttggcctgtgatctttatacgccgggcggctttagcgcgcgacccgtgcacggtcacagcggcgccggaagctatagcttccggcgccttcgcgcggctttccgaagcgcgtcggctgccccgctgttcgcggcacatctgactaaagttttttagcataccttttttttaaaaaaggtatgctgacagctgcgtaatgaaagggatagtcaaaatggaaaacagcgtggtaacggcgaccagccgcgcgccgagcgcggcgtccgcgccgtagcgcgcaggcatcatcacgcaactgatcgccgtgggacaggcgctcgcaatcataattccaagcgaaaccgtttttgctccatcaaaccaggaaggtacgcgcagcgccacaagcacagccagcatcaaaagcggcagaatcaacagccgcatcgcggccgtgagccacaggcggggatcgttaaacaacgttttcggatcaacctccgcaatcaaaattcctgtgataatcatcggcagcggcgtatttaatcccgcaagatatcccatcgcatcgtgcaaaataccaggcagccggatgcgcagcaaaaacatcgccgcaccaagcagcgctgcaacaacgcatggcgtcaggagaaattcgcgcggcttaacccggcgcgtccgccgcagaatcatcacgccgtgcgaccatatgtaaagattgaacaccgcaatataaaccgctgcaaccagcgcgccaagctcgcccatgacggcgctcatcagcggaattcccataaaaccgcaatttgaacagattgcggacagccggcccacagaatcataatcattgcgcattcccctgaacacaagctttgtaaccggaatggataaaaggtgaaatactgccgccaacagcgcagttgctgcgatcaacaagcccagttctggttcaaaatcgcgctgaaacgattgtatcagcagcgtaggcgtgacgattaacagcacaaagcccgaaaactgcccggccgatacttccgaaacgatgccgcgcttgcggataaaaatcccaacgccgagcagtataaacattacggcaacctgttctgccaatttcagcgccattcttcaccaattcctttccagggcttgtttaaaaatagagaaatttttgaatttttcaaaccgcccctggcgcgcgattgcgcccttttatcttattccgcaagctccgcccattcctcgataagagcgttgagccgctctcgcgtctgttcgagctgcgcgcagacttcggacaccttttgatagtcgcttgatatctcaggcgcggccagtgaagcctgaagccgttcgatctcgtactcgtgatcagaaatcgcctgctcgacttcgatcaggcgatttttacggcggaccgcttcggcgcgctgctttttgctgcgatgatattcgccggcaaagcttcccgccggcgcggggcgcgccgcctgttccggcgctgccgcgggaaagcccgcggccggcgcgccggggcggcgcgccgcaaggtatgcgtcataaccgcccttataaagcgtaaaaccttcctccgtcatttcagcgatgcaggtcggcatccgcgagagcaggtagcggtcgtgcgaaacggcgagaatcgtgccttcataccgcatgagcgcctggtcgagcacctcgcgcgtggccaggtcgaggtggtttgtcggctcgtcgagcaaaaggacattgccctcctcatacatcatgatcgcaaatttcagacgcgccttttcaccgccggaaagcatttcaacccgcttataaatcgtctcgccggaaaagcgcaggttcccaagcattgtgcgcacatcgcgctcataagccgccgggaaccgatcccacagctcggcaagcgccgttttgcccggatgcaggtcaagctgttcctgttcaaaataggataccttcacattgcggccccaacgaattgagccggcctccggcttgagccgcccgagcagggcctttaaaaaggtcgatttgcccacgccgttgcggccgacaatcgctattttttcgccgcgcatcaggtcaaaatccacagtttggcacaatatccgtccaccggccgcgccgcccgcgcgcagcgtcaaacccgcgacatgcagcacgtccctgaccggctcctgctcaaaatgaaaggcgatgcgcgccggcgccggcggaggcggcggacggtcgagcggctccatgcgctcaagctgcttttcacggctgcgcgccatcgcaacggtcgaagcgcgcgctttgttgcgcgcgatataatctgtcagctttgcgatattctgccgctgcatctcatattccttgacagcgcgttcatacgccgcctcgcgcgtatgcatatactttgtatagttgccgcggtaggctgtcaggcgcagattagccacatcccagatgcgcgtgcagaccttatcaagaaaataacggtcgtgtgaaacgactatgagcgccccgcgccacgcctgaagatactcctccagccattgcagcgttataaaatcgagatgatttgtcggctcgtcgagcatgagcacatccggctcgtcaagcagcagctttgccagcgccagacgcgtcttttcgccgcccgaaagcgtaccgcagacggtatcctgatcacggccgccaaaccccatgccatttaaaaccgtattgattttgacgtcgatgttgtagccgtcgtttgtctcaaaataggattgcaggcggccgtattccgcggacaaagttttataatcgccgcctgcgcggtccgcaagcgtttccatctgcgcggccagacgtttggcctgctcctgcgcgtcgagcagggggcggaatacgccgcgcatttcctcgcggatggtgtttgcgctttcaatcccgctgttttgacgcaaaaagccgatgcgcaggccgccgcgcacggcgcgttcgccctcgtcgggcgcaagcgagccgtcaagcacgtttaaaagcgtcgatttgcccgcgccgttgacgccgacaaggccgatgcggtcgccctcctccacatttacggagacgttcataaatataaccttatcggcaaataatttactgacatgatccaggctgatgagcatacgttcccctctcccccgcgctcattcgtccccgccaagcagggctgccgcgtccgtttccggcagctcgccgacctgcgccaaacgccggcggatagcgcgtgtgcgcacgccgacaagcttgtcaagctcgctgcccgcctgttccagacgctgctgtgtcgtttcaagcacgtcgccgaagcggttgaattccgttttgactgcgccgagcacctgccagacctcggccgaccgcttttggatcgccaacgttttaaagcccatctgcaggctgttaagcagcgcggccatagtcgtcggtcccgcgacaaccaccttgtagtctcgctggagctgttcgaccaggtcaagctggagcacctgtgcatacaggccctcaaacggcagaaacatgactgcaaaatcggtcgtatgcggcgggtcgatgtatttatcgcggatgtcgcgcgcaaacgccttgacgcgtgtctttaacagcctggccgcctcgtcgattgcttcgcggtcgcccagatcatacgcctgcgtcaattgtatataagcgtcggccggaaatttcgcgtcaatcggcagatagacgggcgtctccccatcccccggcaggaccacggcaaattcaaccgggttgcggctgtcgcgccgcgtcgcaacgttcgtttcatattgaccgggcgcaaggatatcctccaaaatcgcgccgagctgcacctcgccgagaaggccgcgcgttttgacgttcgaaagcacctttttcaggtccccaactccagccgcaagcgtctgcatttcgcccaggcccttgtatacctgctcaagccgttcgctcaccattttaaacgattgtccaagacgcgtttccagcgttttttcaaggcgttcgtcgaccgttttgcgcatctgctcaagctttgcggcgttgtcctcctgcattgcggacagcctgttttcgaccgtcgagcggatgcccgaaagctgctgttcattctgcgccatgaattgggcgaaccggccgtcaatgccgcgcgtcagctccgcaaccgttttctgcaggctgtcctgccggattgaaagttcgcgcgattgctgctgctgaccagcagccagcgtccgcccgagcgattcgactgcttccatcgccgcccggctgctctcctggcgcgtttggcgcgcttcctccgacagcgccgtgcgctgccggtccagcgcgttataaaggccgtccatatcggtccttccattgccggcagctttggcggctaaaatggccgcggctgcggccgccaataaggaaaagagcgtcagcagcagcaggataaaaagaaagggttcctgtggcatgatgtttcctccaaaaagaatgcccgcgctgcgggcgtttcgtattttttttttaccggccatgattatatggcggctgcaaagggcacagccgtttgtactgcgcatattatagcataatttttccgccaggcaaagctatgtttttgcgctgaaaaccgggggcctcccttttgtaaaaggaggccctttttaatgattgatacagtacttacattacttacagtacctacaaacggtggattcaggctgaaaaactgggcaaaatcccctttggtatgctgttttgcagggatcttggtgtttgtgtcacggtggtcggtttcggtttgtatggtggtcggttttggtttgtacggtggtgtgattcggttagtttggtggtgtgattcggtttgttttgccggttggaagttatgttatactggttacaggctgtttaaggtttgttccattcatttttttatgtatgaattgaagcgaaaatcgatgaaaacagaagatattgtgaggtcatttgttttttagaaaaaaggtactcagtttcggttagtgtgtaccaatatgtgatcagcttccctttttcgatcttttacagcgtttgcctgtcctggattgacatgaattttacgctgcttttccagaaatggatttgattataagcgttagaattcggctgaaaaattgtgtaaatggacgataaattgaaaaattgttttgatggtacccagtttcggttagcttgtcactggcttgtcaccatcgcgtgtttctggttggatgccggcgaaaatattggccgccaacaaaatctgcgttcagccgcatagcgtctgtcacagattttgcttggggcaggcgaagcagcctgcataaatactgaaacctgtcctgctgttggcggcacagccgattaaagttttttggcttacccttttttcaaaaaaggtaagtttcaaaaaaacgggaaaatcggggatttctatacgcaaggtatttgctttacggggtttttgtcggattttcgttataatgatgggctgcataaacaaaagaattcagccgataacgggtgattgaacgagataatctctctaaggttcttaaaaggtactcagtttcgggtagtggtaccatttaagaaaatacggattgtaaaaagtgatggaaacgcttgatttgcgcacaaaataaaataaggcctaatgctttgaattccgacaaaaataaaagaatttgagagataaatcgatatttaaataataaaaggtacccagtttcggatagtgggaactgatctgtgggactgttgtctgtaaaggttcggcacttttcacagtcagacgccaagaagctttttcagaatatcattgacaagcttgctgtcagtcaccttttgggcaacggccgcccggtgcagcgcgtcaatgacggccgcgtcgagataaaatgttttgttctttgcgcttctcccctcgtcgcgcacgatgaatgcggtcaaatcgactgccggcgcggccttcgcgcttttcgaacgcgccttcggctgtgcgggaagcggctgcggctcccggctgccgctgtccgccgcgggtggctccgggtgttctgcctgggctgccgcgccgctgtgcatatcctgaagcggcatttccgccgctgtgccgccgggcgcaaaggcgcccggcgcggtggaggctggcgcctgccgttccccttccgcctgaccgtccggatgctgccggcgttccttggcctggcgttccaatacgcttttcgtaaacttgtttgccatgagtatgcccccctgaatgcagtttgatacatggcgcgggccattcgtccggcgaatagacgcgcgcataggttttctgttcgctgcctctattataggatatttttttcgaacatttcgtcgacaagcgacgcaatcgcatcgcagcctttggaacgcaggtcgtaaagcgagatcggtatagcggccagttcgctttctgtgatgcgcacgttgcgcgggataactgtctggaacagcagcgcgcgcaggtcctctacgtcgggcgaggtgcgaagatattcgaggaaatctgttgacagcttgttgcgctggtcgtaatcgttgacgatgaagccgcggatattgtcggcgcggcgcaggcggcggcgggcgtcctcccacagcgcgatgaaaagctgcgcgccttcgatggcgttcatggaaacgtcgctgacaagcagcacggcgtccgaggcgagaaatgcgttttggttgacgatcgacatgcttgggttggtgtcgatgaaaatatagtcgtaggcatcaaaaaattcccggttgtcggccagatagtttgagaggatctgttcgcgcccggcgacggatgctattttcagctccgctttgtgcaggaagatcgacccggcgatcatatcgagctgcggcaggcgttcgatcggctggcgcacgacgagcgcctgcgggtcgggctggtcggtttcgatgttatatatatcgtatgttgtgagaagatccgcgcttgtgcggtcgatgcccatgttgtttgtcagattgccctgcaaatcggaatcgatgacgagcacgcgcttgccaagctgcgacacaatgcccccgatgttaaagcagagcattgttttgccgacgccgcccttgagcgttccaaaggtgatgatttttgccatggccaaagcctccaatagattcgttattgtataaacgattcaattatttaggacagtataccatacaatcgctgtgatatgcaagcatataatgtcgattgtatgcgtaaatacagtgttttatacaattgaaaatatattaaaatatacattttttattaaataagccattagataacataatatattttaacatataatatttaatagagaaacaaatgcattagttaatataatttatattagaaaaacaattatattgtcgaatagaaaagtgaatatgcttgcgattcaatccgcggatatgataggatataaattaaggagatgatcacatatgcaatgggacgagcgatttctaaacgagctgcgcgcgctgctgcctgaatatatggctcagaagcgtattgtggtcggtacacgcgggaaaaagctgatccactgcatcaatcccgaacaccgcgacaggaccccgagcatgtcgtaccatccccaaagccggcggctgcattgcttcggatgcggggccaactacgacctgtttgacgtgatcgcgatggattacccggactgcgacagtttttcgcgccaggtcaaaaaggcgtgcgagctgtttgatatcccgctgccggacaatgcgcccgcgtcaaagcccggcgtgcgcgccgtcaggcccggcgccgcgcgtcccgcgccgccggcgcgcctgacggccgattatacggacatggtccgcgcggctgtcgccgagcacggagccggcgggagctatttcacagcgcgcggcatcccacgcgcgctgtgcgagcggtacagcctttacgaagccggcggccgtgcctggatgcccgttttcctggatgggaaatgtacctgctactgcgcccgcgctaccagtgacaatataacgccgcgctataaaaacagccccggcgccatggacatatttaacgccggttatctgaccggcgagggaaagggcggcgccctgttcattgcagaggcgatccttgacgcgctgtcgattgaggcgtgcggctatcgtgccgtcgcgctgtgcggcgcggcgaacgtggggaaatttctgtcgctgtgcgccgcgcacccggcggccgccgccgggtatacgctggttgcggccggcgatatggacgcggccggcgaacgtatgaaccgctctttaaaggagggactggaggcgctcggcctgtcatgcgcggttttgcagcttccgggcggcgcgaaggacgcaaatgagctgctgctttccgaccgggcggcgcttgcgcgggcgctggcggagtccgccggcgcggagcaggccgcctatgcggccgaaagcgccgcccggtcgcttgaggcgctgctcgacgcatccctgcgccgcgccagccgccgcgcctgcccgacggggtttgcggcgctcgacgatgcgcttgacggcgggctgtatgcggggctgtatattataggagcgatttcatcgctcggcaagacgtcgtttgtccttcagatcgccgattatatcgccgctcatgaaacggatgtgctctttttttctttggagatgagcaaatttgaactgatggcaaagagcttatcgcgcctgacctatcaactcgacgcgccggccggacacatgcgcgcgtttaccgcgcgccaggtgctgcgcgtcgatccggatatgccgcttgaaaaaagcatgctgctcaatgaggcgctgggcgaataccgtaccgccgccgaggggctgtttatctgggaagggctggcggacatcggcgcgcgtgaaattcgtgagcgcgtacaaaagcatattcagatccgcggctgcaagccggtcgttgtaatcgattatttgcagatcctcaagccggacgacccgcgcgcgaccgacaagcagaataccgaccgcgccgttgtcgaactcaagcgcatcagccgcgattttgatctgccggtgctggcgatatcgagctttaaccgcgaaaattaccgcaatgccgtatcgatggaagctttcaaggaaagcggagcggttgaatattcatcggacgtcctgcttgggctgcaactggccggggcaggggaggcgggatttgacgtgaacgcggccaaggcgcgcagcccgcgcgcggttgagcttgtcatgctgaaaaaccgcaatgggattccctatgccaaaattgaatatgcgtatgcggcgcggttttcatattttggcgagggacgcgtgtcgcataagccgtaaaaagccgcagggccggggaaaatccccggccctgcggcccggtgatcggaggccggccgcccgcaggggcggttcccgggccaaagatggcggttcaatcgtgcccccaaaagggggtgtgcgtatggagtacttaatcgtattggtaattttgctaatcgtggtagactccgtcctgcacaataaaaaacgataaccgccccaccctgagaaagtgaacggttatcgttagtacttagcagggggcgaaccgtctgccggcaacgcctctttatatatattgtagcacgcgtcatcgccgtcgtcaagcatagggaaaagattgacagaaaatgtcgaatattgtatcatgaatacggcgctgccacagacggcaggcggttaagccactcccttgagagagggggggttatgtatggtggaattgttgcttgcgattttattagtcgtggcgattacagaagccgtaaaatacataaaaaagtaaccgccctcacaaccaaatgaagcggttacttttccactgaatttgggcgaaccgtctgccggcagcgcctctttaaaataattatagtatacgccgccgcggctgtcaagcgtggcggttatatattttaaataggtagcgcacaggattgcagcaaaatactacaaaatgtaaaaacagatggtgttatgacaaaatgttcttaaagtattaaaagtttattcataaaaaacaaggaaataaggggcaataggttggaaaacaggctttgaagtgttaattatgaagaaaaagttacaaagtggtaacaatattgcttgacatttccaatgcttgtgttatactaaagccacaaggaaatggctggagagtgtttcctgtacttaaccatgaatttattcaaggaggagatttaccgatgaaaaagcttctggcggctgctcttgcggtcgcgactgttgcttctttgagcacggtttctttcgctgctacggattggtatgtcgaaaattatgatcagactaaggcgatctttgacgacggtacacaggcggcttatgatggggccaacagcgtaaagccgaataagactctgtatttcgcgattggcgatctcggtgttcaggctgaaggttggactctcagcagggagtattttagcgataaggattattttaaggtaaagaccgacaagggcgatgacaacgtcaagatgattaaatccatggcgctgtctgagaaaaacatcaagggtgatcgtggtccttggtttgagatcaagctgaacgacgattacaccgacaccgagtataagatcaacccgtccttcacgctgaccgcgaaagaggatttctatctgccggctggcggaaccacccttcgtccgaacgatgacaattccatgggtgctggcgatgttgttaaggttgccaagggcgacaagatccactatgaggttggcaagtactacatcagcaacaccaccgatgacgctgatcaggattacatggctggcgacggcggcgttgtgctgaagcccaccaagaacgacgacaacgagatcacttgggaagatgagaacaacacgatcgccacgctgaagttctacagcgatgacgacgctgcgaagttcttcccgaagctgaccacaaagtgggacaacgctgattatgccgagtatttcgctgatcagaatgcgttcatctttgatttcgttggccgtgccgctggagagaccaagatcgcttccaccagccgcgctacgctcgaactctacaatccgtactatgattgggatgaggacgcgctgacggttgctccggaagactgcgtcatctatcagatcgttgacggcgagctggtcgatgtgaccgcttccttcaccgctctgcagaacgatgacggcgactatgttttccagaccaagacccgtgaactgggctgctacatcatcgccgaggctgaggctgccgctgttgtggacgagccgaccgctccgaccgatgagaagccggtcccgaacactggccgctaataattgttaacatctaacatttttggttctgttaaagggacaggcgactctccacgcctgtccctttttttggctgttacaataaaaaagcaggctgcttgacaaacagcctgtttccatgctagaatacagataaagaggcgctgtcaggcagacggtatgcccccgttatattggaaaacgataaccgttcaccgtgggggtggggcggttatcgttttttattgtgcaggacggagtccaccacgatcagtaaaatcaccaatacgattaagtactccatgggcacacccccttttgggggtacgattataccgccatcttcggcctgaaagccgtccgcgcgggcggctggcctccgatcgccgggccgtggcccggcgtgccgtctgtgacaacgccggttatattgtacatgattcgacaaaatttgtcaaataatgtttgaaagtgaatataattatacaaaaaacaacaagctatagtagtttctggacttgagtatacaacagcttgtgtacatgaaaaattaataatatattaataaaatagaaataaatatgcaaaaaaagaattaaaaaatgacaaatttgttacaagcatgccgcaaaaagttacaaaatggttacaaaaatgcttgacattgtcatttttagacgttataattggaaacagttaagggaatggttggagggccgcctttagccaagatcatttaaaactgatttttcaaggagggaataaaccattatgaatgcgaaaaagcttttaagtgcaatgcttgccggagcgacggtcatttcgattgcgtctgtatccgtctttgcgggcaatgtggcgatgggtacagcttataacagcgacggtgaggcgtcggaagatattgtcggctttacatccagcatcagcggactcgctctgaactcccaggccaatataggcgctgatcccgtttatccaggctcaacggtctatattccgctcgcaactgaaatgaacgaaaagtttggatcttccgctgtttttgtagaggatgtcgtgaatgaggattatttcaagttcgacgttgataaagatgtcaatgccaagcttgtgaagtctgtcacgattgttgacgacaaaaaactttcagacaatttgagccgttccgcatatcttaagattgagtttgcggatacaacttcaacagatgaaagtaaaacgaccggcgatatcacctttaaggcgaaggcggattttgattcttatgcaaaaaagaacgatcagccggttacaaccggaagcaatgtctggcagaaggatgacaggttcaccattcattacaatttctgggtcagcaaccgtgaagttggcaacgatgacaacccggatacaggcgatggcattgtgatgaatccggatgacaatgacacgaatgttcttgtctggggcgacgaccgtgcagcccttgagtttgagtccgacgatgacgcttccaagttctatgcgaagatgtccacaaagtctatcgctgacatctatactgaatacggcgatccagtcgacgcggatctgtggttctatgactttgtcggcagttcgactattccgtcaacctcccgcgcttggctgacgcttggtattccgtgggatgacaatgacgattatacgccggaccccacgtcttgctatatttatgagcttgatgccgacggtaatctgacggatgtgacgagcagcttctcctacagcgaggacgagcgcgaaatccccggatggtcgcgtcagacacggacgcttggcacctatatcgtttcggacacagagcttgacatcgctcccgttgacgatacgacaacagacgagcctgctcccgaaccggagaccccctccacaactccggaaaaaccgatcccgaataccggccgctgattttgcgccggatttgacagggaaagagacgcacaatagagaaaaagagatcatgccgccggctgcctccacagccggcggcaattttaataaaagcgtgcctgctgacgggagcggaaaatgattaaaataactgcagggtaattataaaaaggcggtaaactgcacagcttactgcctttttgcggcagaggatgaacaatcgattatatcaatgcggggagaaattgaaacagggcaaaagcccagcggaaagagccggtcaaaaagatgccgttatgcatcctctattattttcgcccgatacatgcccagcttttttaaccgctcggctatgacataaacgtccaacccgtccattgcaatacgcctgcatttacccggcgtcgtctgtgaaaaggtatcccatactgtaaagagacgggcagtttccgtgagtccgttacgctgcaaaagggggacaaagcggcgcggcgacggagaatacaattcgatcagcttatactttttaataaagagctcctcccggctggtatgggacgcaactgcaaattgagaaattccgtcttccagcaagatttgtccatataaatttaagatggaatcaatttggttttgcgtctgcccatcaagatagcatacttcttgatgtaaaattttatcatgcccaagctgccgttcctcttggatggagagcggtaattgcaatacaaaaaacaaaggctcgggaaggctatgataaaattctgtaagcagaaattttaattttccaaagctgatatttgcccgaatggcacgtccttcaaaaacctgaaattgttcccggattttctctggaaagggtatggtcactccggacgctgtttggaacatcttctttccccctgtcggctttatgagcaaaatggataaaaagagcctggagcatacattgactccaggctcttgtctgatggagcaggtgacgggaatcgaacccgcgttgtctgcttgggaagcagaagtgttgccattgcaccacacctgcaaatttatttattattataccggattatgggcggaaagtcaagcccttcctgggatatgccgcaggtacgggcattttttaaaaaagaatataaaatgcaaatattttaagtgattgttcgaaaaatcttgtcttttgtcattatgccatgtatactactattatagatcaaaacgctggcggaccagcgaatgggaaagacctaaatacagaaacaggagtgattggcttgacggcattgctcgaacaggtgcgcgattatcttgatgcacaggaatggaattatgatattcgcggccaggaagacgatgaatatatgatcatgcgcatgaatttaaaaacagttgatgcgtgtaccacggtcatgcgttcgtttgacgaggattcctttgttgtttatagtatttttccgattaaagttccggaagaaaaacgttccgaaatcgcagagttcatcacacgcgctaattatggactcaatcacggcaattttgagatggatttcgacgatggtgaaattcgatacaaaacaacggccatttggggcgatctggaggtaccggaacgccatatggaccgggtaatcaatcttggattttgtatgctggaccgctatggttcgggtatcctgtccgtactgtatggcggtgcagacgcagcggctgcgattgataaaattgaaaacagtgacgactagggctttataaccgcattataaaaacaggccgcgccgcgaacagcggcgcggcctgttttaagtgggcgctggcaaaatccatgccagccgcgcggcgtctgtcacggattttgctggcggaagcagggcgcgcgtgacccgtgcgcaggccgcccaccgccgggaggcgtgcgcaatccgtgcgcggattgctcaccgccggacgctgcgcttgcccggccggctattcggggctttccggcggctatagccgccgggcgcggacaagccgcggctgcgcccctcagcgcgcctcatgggacaggggcgggccgcccctgtcccatggacccaaccctggggcaggcgcagcctgtataaacgccggaacccgccccgctgttcgcggcgcagcctgtataaacgccggaacccgccccactgttcgcggcacagccgattaaagttttttggcacacctttttttcaaaaaaggtgtgcagggaattgtcgtttttaagatacttataggatagcaggcggtgttggcaagcgacttatgagggaccgccaagggagggaaaccagtatgacaaaaaaacgatggctgattccggtgctggtgctgctggtgattataagcgcggccagcgcggcattttttctttcgcggccggagggcgatatgatctatgcatccgtcaatatccagccgcaggagcaggagagcacagagccgctcgcgcctgaaagcacgtttgccattacgcttgattacagcgtgtcgcaggagcagttgcgtgcaatgctgtccattgaacctgatatcggggaatatacgattgaaggaagcgggaaaaaatggacgctgcgtccggcagtcccgctggaggaaaatacggtttacaccgtccgcgtgatcaatccggataccggtgcggcggtgcagtcgtttgcctttcagacacgcagcgatctgctggtgaacacggtttatcccggcgacggcgaaacctttgtgccgctggaaacgggaatcgaaatgactttcaacgcgcaggatgttgatctgcaaaactattttgaaatcaagccggctgttgccggaagcttcgagacaaacggctatacagttatctttaaacccatggagccgctgacggccaacagcatttaccgggtgacgctcaaagccggattgacggcgccgggcggtatggcgcttaaagaggattatacgttttcgtttgagacggtgcaggcagaggatgcgcagcgcgattatgagaagctgcggcttgacggcccgtatgcggagacctttttgccaggcgatccgctgacagtcaagctgcaaagcggcggcgaggtatccgggctgccctttgaggtcaaaatccatcgttatggcgacatcagcggatatatgaaagagctgcgcgcatatgacgcgttctatcgggagcggtacggcgaaaagacagaatatgtcgccaatacgaccggtctggaagaagttgcgtcttataccggcgagctgttttccaaagatgacggatggggcgaattgtatgcgatcctgccggatgatctgggggaaggctggtatgtcgtcacaatctccggggaggacgcttccggcgccgaccagtttgtacaaaagctgatccaggtctgtaatttaagcgtttatacacagtcggccgacggcgacacattgttttggctcaatgatcccgcaaccggcgagccggttgcaaaagccacgctccagcttgaggacgtgaacggtgaaggcgagttcccagcggttacaatggccgatggaacggcgcgcgtgatgacaggggaaagcgaagccgcttatttgacggtgctgcgcgatggaaagagcgtctatttcgcgcgcgcgcccctgtcgcaggcggtcgagacgccgccgctgtccgaacggtattatacggcgctttataccgaccgcgaggcttaccagccgtcggataccatccatttttggggcgttgtcaagccgcgctccggcgacggcatgctgccgcagagcgtatgggtgtcgctttccacctcatggccgcgtgcggaggtttaccgcgtgaaagcggctgtcaatgaggcggacggcacgtttgaaggcgcgattgccgtaaccggcatcgccaaggattattatgagctttccgttaacgatggagagcagggcgtttacacctccaaggggctttcgctcgaaaaatacataaagccgccgtatgaaatcagtgtggctttggataaggaccactattattttgatgaagcggttggcgtttccattacggcgcgttattttgacggtacgcctgtttcaaatgaaacgcttacgctgacaggcgcttacattaccgagcaatccgtgacgcttgacgcatccggccgcgcgaactgcacagtcaggctgaaagcgccgaacgatgaaaacgatccgatgggctggtcgccgcgcagcctctggattgaggcgcacaatgcgagcgcccaggacgtctatgtttccggcagcgccaatgcggcggtcctgccttcgcgcgtcgcgctcaagctggagggcgattccctggagaagctgacggtgcgcacggcgcagctcgatgatacgaaattaaacgacggtcattccgtcagcccgctgaaaatttatgacagcgaatatgaccggctggcgggcgcgcctgtcgatgtgccggtgacggtgctgatccacagcgtcacacgccgtcaggtggaaaccggaagttattatgattatgtcaataaacgcacggtgacagaatatgaaacgcagcttgacgaggcggtcgccgaaacgatcgagacaaagacaagcggcggggttgttgcaattgaggggctggattacaaaaatacggacgatacaacctattgggccgaggcgcgcgttgacggcggcgcggccggcacggtttctgaaacaaaccggttcggcacgcggccttacggattcagaggcgacacgccggtttatacctttgtcaatccggacgatgaagccgcgaacgcgccggtcgatgtgggcgatgcgatcacgcttgggctgtaccgcaacggtgtaaaaaccgaaaataccggccgtgtgctttacagcgtattgcagcgccggtcgctcaaaaatggaatctttgaaggggattcgcagacgttaacaatggaggaaagcttcctgccgaacgttgtcattgcgggcgcctattttgacgggcggcatatctatgccgtggaggaatatgcggttgattatgattacacggacaagggattgaatgtgacggccgagacggacaaagaaacgtaccggcccggcgaaacggcgacggtgacgctcaagctgacggacgcggcgggaaatcctgtgtccggctccgtctgtgtgggcgtggccgacgaggcggtgttcgacgtcgcggagcagcacgcagagctgcttgaccagctttacagggcggtctattatccgcgcctgcggcgcagcctgtcgtatgcggaatatgataccggcgctgatgaaaaggcaggtgccgaatcaggggacggggcggtcccgatgagcgccaataccggcggcaacgcgggcggcgtattgctgcgcgaggactttgcagacacggcgctgtttaaaacggcgaaggccgatgaaaacgggcaggcaaccgtaacctttgagctgccggacaatgtaacctcatggcgcatcacggcgctggctgtgacaaacgatctgaaggccggcgacacggccgaacttgcggccgcaacgctgccgttttacctgtcgccgctctatacggatacgtatctggagggcgacgacgttgtgatcgcggcaggcgctgttgggaccggtgcgcataccggcgacgcggtttcgtatacggtcacaatcgccgacgccgcgggcagggagcttgacaaacagaccgccgaaggaaccatcggcgtgcgcgtgccgtttaccttcggcaagctggaggcgggcgcttatacgctgacgatagaaggcgtgtgcggtgaaaacagcgacgctgtgcgttatccgttttctgttgtaaagcaggcgctgacaacgccggtttatgaaaatatgccgctcaaggacgccgttaacattgaatcggtgcgttatccggtaaagctgatggtgtacgaccggcggatgcagccttatatggaaggtttgcagtatctttccatgcaggcgggcgaacgcacggagatcatcgcggctgcgtaccgcgcgcagcttgcatacaatgagctgttggacgaagcggaccgcgagccggtgcgccgggacagccgtctggatgatatccagaatgacgacggcggcgtgcggctgctgcctgtgtctgaaagcgacgccgctgtgacggccaagatgctggttgcggctccggaactgatcaacaagggcgcggcgcgcgattatctcaagggcgtgctccaggacccggccgctacgcaggacgaccgcgtcatggcctatctggggctggcggcggcaaaggaaccgattttgcttgatctgctgcgcatcatctctgaggagggcgcgtccatgacagacgcgcagcgcctctatctggggaccgggcttgcgctgcttggagactttacatcggctgatcttgtttataattcgcttggcggccgcctggttaaggacggagatatgctctatgccgaaggcgcggacggcacgctcgacgcgcgcattcaaacgtcggctgcggcgctgatgcttgcgtcggttacatccaatccggacgccgacgcgctgatgcgctatatgaataaccttgaccaggaccgtgcaaagagctacagcacaattgccaatttggagatgctttgctatatcaattcgtttataccatcacagaaaggagcggaaagcttcagctacacggatacgcagggtgaaacccaaaagcgtaccctggaaaacggcggtgtggaaccgctttccatgagctatgaggcgctggcggccgccgatttccaggcaaacgatcatgtatatgcctgcgcgctttacacaggttatgcagacgcggcgcagatcccggatgacgaacgcgtacagatcaccaagacatatacgccggtcgccggcgatgggatcggcgtttccgacagggtacgcgtcgatttaacggtgcgcttttccgatgacgcgcctgacggctgttatatcgtctccgattatatcccatccggtatgcgttatatggaagcctccggcgtatcggagatcaatccatactttgattggatgtggggccggatcgacaatgaaggccaggccgtttttgggcgaatctaccgcaatattgccgtttggcgccagtcccaggcggcgcgcgccggacagcagtccggtgaaagggcggtcccgctgactgacagcgcggcggccgaagaaaagatgatcccttcaaccaacggtacggtggtgcaggaggacacgaatgtatataccctgacgtattatgttagcgcggcgcttccgggcgaatttgtttcggaaagcgcatatgtaaccccgtatatcgagggcgcggccgctaagagcgagcgcggcacggtaacgattgaggcggagagctgacaggcggttttgtatgggcgcgcccccggcgcaggtgctttttcgcagaaaaagcccgcgccggggaccttggcgggccgggcggcctcatggccgcccggcccgcctttttgccgtttccccatgcggggaaacggcggaagcgccgcgcgccttagcgcgcggcgctgtctgtgaggcggcggcgattgccgccgcctcacagacagcgccggacgcgcggaaaattcgcgcgtccggcggttgtccggtggtaatttgaaaaggaatatggtacaataaccgcagagcggttattataccgggtgatgcccaacggctcgccgcttacgcggcaaccgccttttgatgggcaattgtaccatgccgcttcgcggacatggtacaatatgcgcagagcaaacagcttgctgtttgcagcaatcatccagcggcaactgctgtccggcggcggactgcgcatgccgcgccgcagcataaaaatacagccgcatgaaggctttcagagaagcagccgcgcagccccaagccctgcgagcagcagtccggacgcgcaggccagcgcgcgattggaaaccggcaggcgcgcaagcatccggccggccagcgcgccgagcgtcagacagatggtttgtacgatccccacaacgggcggcagccagacagagccggcgccggcaagcgccaaccctacgcccgcgccgagcatatcgaccgagagagaaaagccgagcagcagcgcctcgccgatatcgattgcgccggagccgtcgagatctcccgcggccggctcgcggatgacaaggatggtcagcccaagcgcgcgaaagcggcggcgcaccggcggacgcgggggccgctgcggctttggcgggagcagagcgcggatacagcaggccaggccaagcgcaattaaaatcaatgcgccggcggcgcgtccggcccatgccggcaaaaatgtgccgagcgcgccgccaagcaggattgctgcggctgcaaaggcggtggacagcagtgcgatcgcgcccttggcggccgcgccgattttgacgccgcgcatgccaaacgccgcgcccgcggcgaacccgtcggcactcaaggcgagtgctgtaagcaagacaagcatgtttatgaaacaccacccggtacaatgttcattccatactatggattcgccgggttttggtgcaaaggctttggaaaggcggccctgaatatgcgggtcaaaatccctagaaacaagccggtttcagcggcgctgcggatggatggtttgatttttgtattcactggttgtcacatctgtgacagacaatatacttttttccgctggcagactcaatttaaaactctttgattataaagtttcggtaaaggcggtatataggatggataaggttggtttttcagcagcggacattttgcttccgaagcatgtggacatgacgcgctggagcgtcattgcatgtgaccagtatacttcgcagccggattattgggaacgcgcggcgcagatggtcggttcatccccaagtacattgcaccttgttttgccggaagtttatctggaacaggacgatgtcggccggcgcattgcgcagatcaatgcgtcgatgcgcgcctatctggacagcggcctgttttacgtcttaaatgacagctatgtttatgtggaacggaccgttgcgccggggcgggtgcggcgcggcctggttggaaagatcgatctggagcagtatgattacagcgcggacagccgttccctggtaaggccgaccgaggggaccgttgaaagccgcctgccgccgcggatgcgtgtgcgcgagcaggccccgttggaaagcccgcatattatggtgttgatcgacgatgcgctgcatacggtcattgagccgctgcaaaagcagaaaaatgcaatggagccgctttatgattttgatctgatggcggacggcggccatatcgcgggctggcgtgtggccggggacttgtgcgcgcaggtcgatgcggcgatgctgtttttgctttcgggccaacaatgctgccgcggcgtatgccgggagtgcgcgccgccgatgctgattgccgtgggggatggaaatcattcgcttgccacggcaaaggcctgttgggagaagatcaagcccgcgctttccgaacgggaacggcgcgtgcatccggcgcgttacgccctggcggagctggtcaacctgcatgacggtgcgctggcctttgaaccgatccaccgcgttctgtttgatgtcgatcccaatagcgtcctggatgcgctgcaaaaacagcttggcgcgtgtgctgatggacaagggcaggtatttacatatgcggcgggcggccgcacaggccgccttgtggtggcaaatccgccgtcgccgctggcggccggtacgctccagggctttattgacggctatcttgccgcgcatggcgggactgtcgattacatacatggcgacgacgtggttatggagctttcaaaaaaaccggacgccatcggttttttgctgcccgcgatggaaaaatcgcagctttttccggcggtgcgcgaaggcggcgcgctgccgcggaaaactttttcgatgggacatgcgtatgaaaaacgtttttatctggaatgcagaaaaatacagtaaggaggctgtctgatgaacagggaacgcttgatccaaacggcgcttggggagaaaaagccggcgctggtcttaaaaaacgcccggattatcaatgtattcactggcgagatcctgccgggcgatatcgcggtaacagatggccgcattgcgggcgtgggcgcttatgaaaacggggaggagacggttgacctcggcggagcgtatgtcgcgcctggctttatcgacgcgcatgtgcatattgaatcgtcgatggtcacgccgccggcctactgcgccgaggcgctgcgttgggggacgacgacgctgatcaccgacccgcatgagatcgccaatgtagccggcggcgacggcgtacagttcatgctggatttatcggagcgtttgccggtcaattattatgtacagcttccgtcgtgcgtgcccgcgacgccctttgaacatgccggggatattttcacggctgaaaaaatgagccgttttctcaaccatccgcgcgtattgggccttggcgaaatgatgaattatccgggcgtcgcggggtgcgaccccgaggtgatggccaagctggagctgtatggcgggcgtgtgatcgacggccacgcgcccggtatctcaaaaaacggtttgcaggcatatatttccgccgggatggctacggatcatgaatcgacctgctgggccgaggcaaaggaaaagctgcgcgcgggcatggcggtgcttgtgcgggaaggttcggcctgcaaaaacctggaggaaatcatccgcggcgtcctggccgacggcgcggacacctggcatcttgcgttctgtaccgatgacaagcacctttccgatatccgccgggaggggaccatccggcataatatcctgcgcgccgttgcctgcggcatgaacccggtgacagccatccagatcgcgacgatcaacgccgcgcgcatctaccgcctgtatgacttgggcgcggtcgccgccggttatcgcgccgacctggttgtattgcgcgatttggagcacatggaggtgctatccgtttacaaggacggccaaaagcagccggaagcggcggcgattggactgatcggcggcggcgccgacgcgatcctgcattcggtcaggcttgcgcccgttatggaaacgtcgtttgcgctgccggattggcatcgttatccggtgatccgcattgtgcccggcaacgtcacgacaacgcgctttgatgtcgacgccgccgaagtcccggcgatgctggcggacggcaggctgcgtaaaattgcggtgatcgaacgccaccacgccaccgggaacatcggcgtcgggctgatcgccgggtatgggctggcgcatggcgcgattgcgacgacggtcgcgcatgattcgcacaatctgatcgtagtcggcgataacgacgccgacatgctggcggctgtgcgtgagattgaacgcgtgcagggcggttataccattgtgcgcggcggccgggtgcttggctcgctgccgctgccggtggccggcctgatgagtcttgacggcgccgatacgtttattcccgcgcttgaccggatgattgatgaagcgcgcgcccagggcgttgcggacggcatcgatccgttcatcaccctcagctttatggccctgccggtcatccctgaaatccgcatcacggacatcggcctgttcgacgtcgtaaacttccgcccgctccggcctttttgaaaaaaagcctcggcaaaaaactttagtcggctgcgccgcaaatagtggggcgggcgctgcgtaaaaacaggctgcgccgccaacagtgggacaggcgcagcttggcggtttaccacagaacgcaccggcgtgcgtccaatgcgatcacaccgcccagaggtggggataacataaggggagggtcgccgaccctccctttatgaggcgcgctgaggggcgcagccgcggcttgtccgcacctcccggcggtgggcaatccgcgcacggattgcgcgcgcccaagcgcctggggatcatgaaaacaggagatgtgccgatgtcctttttgtattcggacagcaacaaacgataccacacatacagttatgcgatgcggcggcggtttggcggcaaggtgatgcgtgtcagcctgaacgcaggctttacctgcccgaatatcgacgggacaaaggggcggggcggctgtgtgttctgttcgccgtcgggcagcggagaatttggcggaaatcccgccgaatccatcgccgcgcagtttacacaggttgcggggcgtatgtctgaaaaatgggacacgcctttgcggatcgcatattttcaggcgcatacaaatacgtatgcgcctgttgcggttttgcggcggctttatgaacaggcgcttgcctgtccgggcgttgtgggcctggcgatcgcaacccggcctgattgtttgcccgatgatgtctgcgcgctgctggaggaattaagccggcgcacatatttgacggtggagcttgggctgcagagcatacatgatgaaaccggcaggcaaatcaaccgctgttatggctatgatacatttttatccggttacgagcggctgcacgcgcgaaacatcccggtcggcgtgcatatcatcaacggcctgcccggggaaacgcggcggatgatggttgaaaccgcgcgtacattggcgcgtcttgacctgcatcttgtcaaaatccacctgctgcatgtgctggagggcacacagcttgcaaagctgtggcgcgccggggcgtttgagctgatgacgcgggagacgtatgtacagacggtctgcgaccagcttgaggagcttccggctgaatgtatcgtcggccgcctgaccggcgacggcgatccggatacgctgcttggtcctgaatggagccgtaaaaagctgtgtgtgctcaacgaggtcgacaaagaacttttgcgccgcaactcctggcagggccgccggcgcgcgtgccccccgcttttttgaaaaaaagcttggcaaaaaactttagtcggctgcgccgcgaacagtggggcaggctttagttttttttacaggttgcgccgcaaaccccggggcaggcgcagcttgacggtttatcacagaacgcaccggcgtgcgcccgatacgatcgcgccgcccacaggtggggataacataaggggagggtcgccgaccctccccttgtgaggcgcgctgaggggcgctgccgcgatttattcgcgcccggcgggcggcaattgccgcctgccggaaagccccgaatagccggccgggcaagcggagcgcccggcggcgggcgacccgcgcacgggtcgcgcgcgcctcccggcggtgggcaatccgcgcacggattgcgcgcgcctgccgaagccttttttcaaaaaggctggagccgcggcgtcaatcgatattgataatctggcggcattttggaaaattcggacagccgaaaaactcgtttccctgattcgcgccttttttggctgtgcgccgcaccattgggacattgcatttcggacaaagcgggacggtaaactgataatttgcaggcggcgtaaacggcctttcctgatgcgccgaaacgaggatatcggcaatggcgcgcatatcctgctcgcttaacaggacgccggtatttgcttcctgcaattttttaagatggttgatcaactgatcgtgtttgataatcttatcccggatttccgccggggcattggcatcctggataacggttttagggttggccagcacaacgacagattgaaggagcgtatcccaatcctgtacgggcagggccggcatttgctcgctcaaaagccgtttgagcagatccacatggcgttgattttgcgtaacagggttatacatgccttcttttttgtaaaccaggccggttgctgttttaaaacaacggttgaaatcgcccttatttgtcacttcgatatcgtcgattagttttttgctttcgataaccaggataaacgatgtggcgatgacaacaaaatcgatctgtgctgttgtgtcctgatttttcaaataaaggtcctgtaaaatcaagataggcagatagctgtttttcagttcataggccacggttttttcaccattcaggccgctggtcagctttttgatatcctttgttaaacggtctgcctgttccgggataatcagctccttccacttttccaatttttcaatctgatttttggtggagctgttttcttttataaaaatcggctctgagaagctcaacggctttacagccggctttggccttaaaaaatccagaaacgccattatttgtcacccttttacgtcgattgatgcatttacattgattggacacattgtcttttatacaaattatacgatagattgacacgtttcgcaatagcatatagtatcataaaaaacagtttgttttcaaaagtgatgggtgatgggtttgccagtatgtgctggcaactggaaataaaggcaactaatttcgctaaagaaagatttaacgaaatttagggggatgcggacagcggatgaagggcgcgccaagcaatcaataaagccaatagaagtatgaatagaacatcgaatatatatttgaatagagattctattcgcggcgtgcctattgtatgacagccaaaattgcggtacaatggaaaaaagccgtcaaaggaaggtgtttatgcagctatcgtttttaggggcggcgcatgaagtgacaggaagctgtcactatctgcaggcctgtgggaaaaaaatactgatcgattgcggaatgcagcagggtccggatgaatatgagcaccaggagatgccgcttgcgccgggtgaggtcgattttgtgctgctgacgcatgcgcacattgaccattcgggacgtttgccactgctcgcgaaaaacggatttcatggaacgatctgcgcgaccgatgcaacatgcgacctctgtgggattatgctgcgtgacagcgcgcacattcaggaatttgaagctgaatggaaaaaccgcaagggcaaacgcgccggccgcgatccgattgaaccgctttacaccgtggacgacgccgaaaccgctatcggcctgctttccccgtttgtatacaaccaggtggagcagctctgcgatgggattgccgtccgatttgtcgatgtggggcatttgctcggttccgcaagcattgaagtttgggtgactgaggatgggaatacgacaaaaattgttttttccggcgatatcggcaatctaaaccagccgcttctgcgtgatccggcctatataacggacgctgattatattgttgtagaatctacctatggcaaccgcctgcatgagccgccgcccgattacagcattaatttggcgcagatcatccagcgtacctttgaccggggcggcaatgttgtcattccttcgtttgccgtcggccgcacgcaggaaatgctgtatttcctgcgcgatatcaaagcgcggggactggtccatggacatgacaattttcctgtctatgtcgacagcccgcttgctatcgaagcgacaaccatctttcaggaaaaccgcgtcgattgctttgacgacgaggcaatggagcttgtaaagcatggtatcaatcccatcacctttttggggcttgaactttctgtaacaagcgaggaatcacgagccatcaactttgacaacacgcccaaggtaattatttccgcatctggcatgtgcgatgcgggccgtatcaagcatcatttaaagcataacctttggcggcgggattccacggtcgtatttgttggctatcaggctgtcgggacgcttggccgttccctgctggaaggcgcaaaaagcgtcaagctgttcggtgaaacgattgaagtcgaggctgaaataacctccttgcagggcgtcagcggccacgccgatcaggccggcctgcttcgctggcttgacgctttccagacgccgccgcgccgtatttttgtcgtgcatggtgaatcaagcgtctgcgaagaatttgcaggcattgtcgcccggcgctacaatgtcccggtgagcgcgcccgattatatggcccgctttgaccttgtcagcaatacaatgcttgatcccggcgtcaagcgcgaggctatgaagccgaagcccgttgcatccgctgtcgtgccggtcggtgtgtttggacgccttgtagctgcgggcaaacgcttgatgcagattatcgagcgcagcaagggcagagccaacaaggatttgacaaaatttacaaaccagattaacgcgctgtgcgacaaatgggaataagggggcgcgcgcgacccgtgcgcgggtcgcccaccgccggacgctgcgcttgcccggccggctattcggggttttccggcggctatagccgccgggcgcagacaagccgcggcagcgcgcctcacgggacagggacgggccgcccctgtcccatggacccaaccccggggcaggcgcagcttgacggcttactatcaaacgcatcagcttacacccgatacgatcacaccaaacagaggtggggataacataaggggagggtcgaacgaccctccccttttgaggcgcgccgcgtggcgttgccgcggcttgtccgcgcccgaagcgcggcgattgccgcgcttcggaaagccacgcgaaggcgtcggacgccagagcgtccgacgccgctgtgacccgcgcacgggtcacgcgcgcctgcgggggtcacgcacgccctcgccgccatggctggacgatcgcgtgtgcgagcacatgagcggcaagcgtgccgacgacgttgatgtcggcgcgcagggaaccgacggacagcgcataaacgctgtcgccgtcggctgtggtgtgcaccgggtctatggcgcgtgcaagcccgttttgcgccatagacgcgatcttggtcaattgtgttttatcaaaggcggcgtttgtgacgattgccgcgatggttgtgttgcctgtaaagaagatccccttgtcggagatatcacggcagagcactgcggtgctgtcggcaaagcccttgccgtcgggcgtgcgcataccggcgatgcgctcatgcgtgtcggggtcaaaaatatcgccgagcgcgttgacgacaaccgccgcgccgacctgtaaatcgcctgcctggacagcgaaaaagccctgccctgccttcatcatggtcgccgttccgccgagcttgccgacggtggcgccagtccccgcgccgaagctgccgcagcgcgggcggttgttttcctgcgcgtcgagacaggccgcatatgccataccggcgtcagggcgcgcgtcgggcgagccatagccgagatcaaagatgcaggacgcgcaaacaagcggaaccttggcaatgccggtgtcaaacccgacgccgcgttcggacagatagcgcatcacgccgcccgccgcgtcaaggccaaacgccgagccgccggaaagcagcaccgcgtggatccgttcggccgcggcccatgggcgcaacagttccgtttcgcgggaggcaggcccgccgccgcgcacatcgacgcctgcgggcgcgccgtccgcgccgccgcaaagcaatacggtgcagccagttttaccggcctgatcttctgcgcagccgatgcgcacgccgtttatatcggagatcgggatttgccgcaaacttatcgcctcgctttcaaaaagatctgaaccggccggcagacaaataccgacagtataattgccgcggccaattcacaaagcccattgacgctgataatcgtcaaaaaaacctcttttagagcaatcgcctggaaaaatatccataagcaaccaagcaccatgacagtatgtgaaaccgccgcgacggccgccgccgcgccgatgcacagctcagggcgcataccggcgcgttgggcggctttgtatacgagcgccgcgatcacccccaacaggatacggggggccaggcacatgatcagcgagctgacgggcgcgccgctggcagccggggaaaaaagcagatcgaccgggccgcccggggttgtgaccgctttaaacaggctgatgcatccaaagacgccgccaaggatcgcgccgtcaagcgggccaagcaaaatggctccgatgatgacgggtatgtgcatcagcgtgatcgataccggcgggatcataatgaatccgaggggcgtaaagccaagtaccgccagcaatgcgacgagcagtgaaagctgcgtcagccgtgtggttctgcgagtggttgccgttgtcataagaaatcgctccttgctgctgctccatatgcggatgcagcgcgttttatttgtaaaggtaagtccccttacatgccggtgttctttttccagacagcataaagcccatcgaggcgcagcgttttgtcaacgagaagcttgtgacggcaaaacggcgcgaccgcatcgaccgattcgcccgtcgcaacgatggaagcggccgggccggccttctcctcgtaccgttcgatcatgccgtcgatcatgctggcgttgcccagcagcacccctgatttcatacagtcgatcgtattggtccctatgaccggcgcgggcggttccaggctgatgtgtgggagctgcgcggcccggttgctcaaagcgtcaagcgatacccgcacccccggcatgattgaaccgccgataaagctgcggctgcggtcgacgatggaaattttcgtcgccgtgccgaaatcgacgatgatgaccggcagcggatatttttcaaacgcgccgacagccgccgcgacaaagtccgcgccaagctgcgcggggttgtcaatgcggatattcagccctgtttttacgcccggcccaatctgcatgaccggaacggggcttgtaagctggacggctgctttgagcacgggcgacaactgcggaacaaccgatgaaatcaccgcgccttttaaattctgctcgcttaagcgatgcagatgtaaaatatggtgcagcaatacggcatattcaacctctgtcttgccggcttcactgacgatatgtgtcaggaacaacaatccgccgtcgcaataagcgccgatattaatattggaattaccaatgtcaatcgataaaatcatactgctttcctgtccttgatcaacggatgtgtaaaacgcggctctgcgcctgccagcctttgcggcagggcggaatatgatttgtacctttttgggcggcttctaataacgcgggcggtcaaaggaaagaatggacacaacgctcgcggccacgccgagcgcgcagccgacaatcaacagataaggaatggccatcagcccataaaacgcggctgtgcccatttccagataggcctgtacagtcaccgacaggccgcaggccatcaggaaaagccataccgcgtcgagcgtaagcgatgcgcgccgtcccaagagcagcatcgtctgcatgacatagacgacgggaacaaccgccatcagggccgaacgcacccaccaaaagagatcgagctttggcgcaagcgcgccgcccggcccgaggccaaacagcgccaaaagatggcacaccagcgccagaatgagcgaaagcccgcagaacccgctgagaacaaccccggccagcgcgccgccgctcgggcgcgaatcctgtatctcgtcggcgcgctgctgcgcgtcctgaaaatagtcgtgtaaaagcgactgcccgcaataaccgcagcgccgcgcccgtccactgacaggccggccgcatttcggacaggtaatcatccgtctgctccctcccctgcttatcaggcggcatgcgccgccacaatatgtccattgtaacacagggggccgccttttacaaggcgcgcagccccggcttgccggggccgcttgcccgccttttacaaggcggcggcccgggcgctacgccctgctttgctccggcgctggcgccaggtacgacaggcggcgcatggttaaaagaaacgcgatggataaaggcacgcaggaaccgatccaggccaggggattggccatgcacgcgcccgcgaaaccgaacatgccggccagcacgagcgcggccagggcgcgcatacaaagctccataatcccggcaaaggtcggtacgaagctttgcccaagcccctgaagggtgtaacggaagataaacagcagggacaggataaaataacaggaaccgttgatggccagatagatctgcgcggtttcaatcacctcaggatggccgacaacaaacaacccgatcaggtttttcccgaaaacattgttgacaatccccatcacaatgctgaacgatacggacatcatcgcgcattgcagcacgccgcgccggatgcgcggcacattgcccgcgccgtaattctgggcggcataggtggccatggtcatgccgaacgacatcatcggctgcgtggcgatcaaatcgattttctgtgcggccgtataggcggaaacggcggtttctccaagcccgttgagcgtaaactgcaaaatgatggaaccgattgcgatgatggacgattgaaaacccatcggaagcgcgacgcgaagatgctcaaaaatttccccgcgtgtgacgcgccagtgttcgcggcgcagatgaagcatgggaaaacgccgggcgatataaacgatacacgcgccgccggaaagaagctgcgcggcaatggtcgccacagccgcgcccgccacgcccatttgaaaggttaaaatgcacaaaaagtcaagcccgatattgatcaggcaggcgatcacaagaaagatcaggggggtgcggctgtcgccgagcgcgcgcagcacgcttgaaagcagattaaagaggacggccgccgcaatgccggcgtaaatgatgacaatatagctgtacgcgccgtcgatgatgttggcaggcgtgcgcattaagataaggatcggccgtgcgagcgccacgctcaacgccgtcagaaacacggtgatcacgccgccgatcaggatgcctgccgcaaagctgcggcgcacgccctcctcatcgccggcgccgaaccgctgcgccgtcacaatggaaagcccggcggtcaatccctgcgtaaagccgaggattaaaaacatgatgctgcttgtacagccgacggcggccagcgcatcgacgccgatcgtgcgcccgacgatcagcgtatcggccatgttgtaaagctgttggaacaggttgccgatcagcagcgggattgtaaaaaacaggatgagctttgccggattgcctacggtcatattttttgtcattctgcatgaatcctcatttcatattgcaaatttccagtgagatcattttacacccggcgcgtatttcgtcaaggggttttcataaattcggcatacgttacagttcgcgcggctcgttcggccattcttttggcttattgacgcaaataggcattgtaaaggccctgtcccccatgctgcgaagctgttctttgctttaaacagccaggccgccgccggaacagattccggcggcggcctgacctgacaagaggattcgctttacaatcaatcatgcatgattgacgttcagttgatgcattctcacagattgacgacgtttaccgggctgccctccaggaacctgcgcagattgtcggcggcgatctccatcagacgttgacggctctctttgggcgcccaggagatgtgcggcgtaatcaggcagttttttgctttcagcagcgggttgtccccccggatcggttcagttgagacaacatcaagaccggcggcatacaccttgccgctgttgagcgcgtcggcgaggtcctgttcgacaatcagcggcccgcgcgcattgttgaggataatgaccccatccttcattttggcgatgttttcccggttgatgattccctgtgtggaaggcagcagcggacaatgcagggcgatcacatcggagcgtgcaaacagcgcgtcaagcgcggtatattcggccagcgcgcggccggcgccgctttcatattcgtcataagcgatcacgttcataccaagcgcccttgcaatacgcccggtcgtctgtccgatccgtccaaagccgataatccccatcgtcttgcccgccagctcgatcagcgggtaatcccaaaaacaccagtcggcattttgttcccagcggccggcgtggacggcgtcgctgtgatgagcgacatggtggcagatttcaagcagcatggcaattgcaaactggccgacagccgccgttccatatgtcgggatgttgcagaccgcgatcccgcgttcacgcgccgcggctatgtcaactacattgtaacctgtcgccagaacgccgataaactttaaatcgggagcggaaaaaatcgtttcacggtcgagcgcaaccttgttgacatataccgcgccggcgccgcgtatacgcgcggcgatctcgtcaggctgcgtgcggtcgtataccgtcagctcgccgagcgattcaagcccgttccagcttaagtcgccgggattttccgtataaccgtccaaaactacaattttcatctgccggtcccctttactgctttgtatgttcatccagccaggcgcgcatggatttggcgcccatctgcatcaggccgatatcgctgctgcacatattgaccgtcataccggcttttatccagcgcgcgagcggttccatgccgccaaaatgcgtgccggaagccttcccggcgtcttttgcggcccggatgacacgttcaaacgccgcgacaatctccggatggccgtactgcccgagcaggccgtaatcctgcgacagatcgttcggccccataaacgcgatatcgatcccctcgaccgccaaaatttcctccacgcgctccacgcctgcgcgcgattcgatctgacaaaacagcagcgtttcttcattcgcccgctccatatacgcgcggccgtcgaccttcataaagtcagtgtgcggccgtgacagcgacacgccgcgacggcccatcggcgcatattttgtaaagtcgaccagctttcgcgcatcctcggcgcattccgtattgggcagcagcaggccggccgcgcccatctccataaatttaagcgctggttcgcgcagtggtccgggaatgcgcacaatcgccggcaggccgatcgaacgcgccacgccgatcatccgcgaacagccgtcataggaaaaagaaccatgctcacagtcgatgataaagaaatcaaagccgcagacctttaatatttttgcaagatcgggggtgtcaaaggtcgtcaccattgtgccgaggacgcgctccccgctttggatacgttttttcaaattcatagctgtttcctccatcgttgtattgccccggggggcgcgcgcgacctgtgcgcaggccgctcaccgccgggaggcgcgcgcaatccgtgcgcggattgctcaccgccgggcgctgcgcttgcccggccggctttggcgcgcgcgacctgtgcgcaggtcgcccaccgccggacgcttcgcttgcccggccggctattcggggctttccggcggctatagccgccgggcgcggacaagccgcggctgcgcccctcagcgcgcctcatgggacaggggcgggccgcccctatcccatggacccaaccctggggcaggcgcagcctgtataaatgctggaacccgccccactgttcgcggcgcagccggttaaagttttttgccgaggctttttttcaaaaaagcgggggcttttttcaagaaagccggtgcatgagggcctcgacctcggcgctcgacggcagcgcccggccgatggaaccctgttttgtgacagccagcgaaccggcgcagttgcaaaacagcgccgtccgctccagatcgtacccttgcagcacgcagtataccagcgccgccgcgaatgtgtcgccggcccctgtagggtcgattgccggaacgtcaataccgccggcagttacgatttgcttgccgtcgctcacgatcgcgccgtttgcatcgcatgtcagcgcgatcacgcgcggcccccaggcgtgcagctcgcgcaggatgtcgtgcgggtcgtcaagcccggtcacaaaccgtgcctcgtcgagcgtaggcgcgatgatatcggccgagcggatcgcttttagcagacggtcgcgggcctcgtcgctgcccatgacctccttgcggatgttcggatcgaatgaaacaggcacgccgtgtttgcgcgcgatacgcacgcattcctgacaggcggcgcgcatttcggggctgacctcaaggagcatcccggcatagtggatggctgacgcgcccgcaatgaacgtttcgtcaatatctgctggcgacaggcggctgccgacagaatttttgcggtaatattgaaaattgcggccgttttcaagatattcgacaaaggaaagaccgatctgcccttcatcggacacgacaatgtgcgaaacgtcgacgccctcccgtttcagcgcgccataaacaaaatcgctcaatccgtcgcggccaaccttgccgaaaaaggccgcgttgccgccgagccgcgcataagcgcaggcgacaatcccgcaggaaccgctggctgtcttgataattgcgccttcctcacagatgcgcagcttcggttccacagggatacattcaacgagcaattcgccgatagaaataaacggccggccggtttttgcatgctccataacttttgcctcctattaataatattaatcaatttctattaattgagactttgatcttattatagacctgcacatgaaacgtgtcaacagttttttgttttgcgctcatatgacagccagtccacactaggggctgtttgaaaaatcggaaataccgtctttttctacaaacagcggtgaatccagcgttaaaaagcctcggaatccgaaaggattcctgtgttttttgccttgtattctcctgctgtctgcgaaaaatccggcaattcctctattttcaaacaagccctaaatttatttaaaaatataggagcattctacattttttcagacttttcccttgacgaacgatgatcgtctgactaaaataataactaataattattaatggagaaggtgtgatatgaagaaaccgacatcttccgatgtcgcgcgtgcggcaggcgtttcacaggcggccgtctcgatgattttgaatgggaaaagcggcgtttccttcagcgccgaaacgcgcgcgcgcgtgtttgacgcggcgcgcgcgcttggatataatctgccgctgcaaagcgctgtagattctgacgggcgtctgcttgccgtacttgtcccaacgctttccaatccatattatacgcagcttttacaggcggttgaggaccaggcggccgcgcgcggctttcgaacgcttttttgcaacacggcgcgcgatgcgcagcgcgaagcgtattatcttgcgttgttcaggcgcagccgcgttgcgggtgtgatttatacgttcctgcccgccttcccccagcaggccgaacagcttgcacagacaattccaacagttttgatcggtgaaaaaaataccgggcaaacattgccgtccattgaactgagcaaccgcaaggccggcgcgaccatcgcccgccatcttttaaagctcgggcaccggcgcgcggcgtttctgtccacgcctaccaaaaacctgacgcttgcgcgcggtcagagattggaaggcgcgcgcgcctgctttgagcgcgagggcggcgaactgctcacgctttttacagacgatgtgtccgagggggattttgacagcgaaccgtacgaatttgccgccggcgagctgctggcgcggcgcctgtttacacagacgcatggcgttacggctgtcatcggcgtcaatgatatgaccgcgctcggcgtcctttcagccgcgcgtgcgctcggcgtacgcgtgccggaggactgctctgtctgcggatttgacaatattttcgcggcgcgtacagctttcccggcgctcacgaccgtcgaccatcatctcgacctgcgcggccgcgccgctgtcgatatcgtgcttggcgagcgcggcgcgctttcaccgcaggtcagccggattgaatatgaaccgcggcttatagcccgcagttccacaggacccgcgccgcagtaacgttcatattttttgcataggaattgcgccgcttatctgttataataatcataccggcttttttgaaaaaaagcctcggcaaaaaactttagtcggctgcgccgcgaatagaaggcttggcgcgtcgcaaaacaaaagttttcgcccgcctttttcaaaaggcggcgggtgaaggcggaggccaaagcccgcaaggggctttggcctccgccgagggcagcgccctgaaccccgggccgcagccctcataaaaagcgcggcccgcaggccgcaagacacctgttcaggcgcaccgcctgcccctagcaaaatccatgacagacgctgcgcggctggcgtggattttgccagctcccaccttccgcttttcccacttttccggcctttttgaaaaaaggtatgccaaaaaactttagtcggctgcgccgcgaacagagggacagattccggcgtttttacaggctgcgccccgggcgcgcgcgccttggtgcacaggtcgcgcgcgccacagaaaggatggtcaatttgcctatacgcaagctgcgccgggcggcgctgcgcgcgctctccagcccggcctttgatatccgcaaaatgtataaagccgtccgctccgtgcagacggcggcgggaaggccgccgcgcctgttttacaagccgtgggatcacatcgtgcgcgtggacgggcggcgggtgccggtgcggctgttcgcgccgagaacaaacagccgcgattctatcctgttgtttttccacggcggcggatgggtgacaggcaacatcgacagctatgaccgcgtgtgcgccaatttgtcgaatatcacaggccgcatggtcgtgtcggtcgattaccggcttgcgccggagcatcgcttcccggctgcgcctgaggattgctacgccgtggcgcgcgatatttttaccgatctatcgctgtttatgatgacgccgcgtcaaattacgctgatcggcgacagcgccggcgcgaacctggcggcggctgtctcgctgatggcgcgcgaccggggggaatttctgccggaaagccaaatcctgatctatcccgcgacagccgcggaccacgggccaaattcgccctttccttccgtacatgaaaacggcgagggctatcttttaaccgcgaagcatattgaagaatatatgtcgctttatatctccagcgaacaggaccgctgtaatccctatttcgcgccgttggaggcttccgatttgtcgcggcagccgcagacgcttatcctgacggcgcagtacgacccgctgcgcgatgaaggcgaagcgtatggcgaacgcctgaagctcgcgggcaaccgcgtggagatgcaccgcatcccggacgcgctgcacggctttttttcgcgttcgccgcgcactcaggcagccaggcaggcatatggatatatcaaccgctttttatgcgaggtgacgcatacgtgaaacgacagaaagccgcggcctggacccggcttgacaacgccgccaaaatttttccctccaccagcagcaaggccgaccccaaggtgttccgctttgcctgcgagctgacggaggaggtggacccggatatcctccagcaggcgcttgacacagtgattgaagcctttccggtctttcgcagtgtaatccggcgcggcctgttttggtactactttgagacaagcgccctgcgccccgttgtcgcagaggaatcacagccgccctgccggccgctttatgacccggtagtcaaaagcttattgttttccgtcacatattaccggcggcgcatcaatcttgaaatttaccacgctctgaccgacgggaccggcgcgctccagtttttgcgggcgcttgtgtgccgctacctgatcctgcgccatcccgaacagttcggggacaatccgcccgcgcttgattacgacgcgtcgctgaccgagcgcacggacgacagcttttacaagcactataaccccgatacaaagcggcgcgccaatatcaaaaaaacgccggcatgccatttaaaagggccgcgcaatccggattattttctgcgcgtcatcgagggtgaagcgcccgttgccgcagtcgcagccaaggcgcgtatgtatggcgcgagcatcacggcgtttttgacggctgtattgatctgcgcgtttcatgaggtcattcccgcgcgccggcaaaagaaaccggtcgccgttgccatcccggtcaatctgcgcaattattttgaatcggaatccgcccgcaatttttttggcgtgttcacagtcggctacacctttcacaagcaaagcgaccggcttgaggatgtaattgcctccgtggccgcgtcgtttaaacgcgagctgaccgcggaaaacctcagccgccggatgaacgcgctgcttgcgctggaacacaacccgcttgtgcggattttgccgctggcgctcaaggacccggtcctgcggctgtcggcgcttgtttcggagcgcggagaaacaacgtcgctttccaacattgggccggttacaatgccgcccgagctgacgccgtttatctcccggtttgacgcgtttgtcggcgcggaccggctgcaaatggtcatgtgctcctttaacggcaatcttgttatgagcattacgtcgccgttttccggcgccgatgtgcaaaagggttttttccgcacgctgacggaaatgggcgtcccggtgacaattgcggccaatacgcttgacgaggaggaataatccgtgcagtactgcgaaaaatgtaaagtccatgtgcgcggcctgcacgcaaactgcccgctttgtcaggggcctttgacaggcgagggcgaaacgccaaacagcgtgttccctgcccacacatatcaggcgccgcgttatcacctgctgatccgttcgatgatctttgcctccattgccgcgatcgtcgtctgcgccacggtcaatatcctgcttggcgggcggcgctggtggctgtttatcgcggcggcagtcgcctgtatgtgggtctgcctttacagcgtgatccgccggcgcaacaatattccaaaaaatattatttggcttgtattctggctgtcactcattgccgtactgtgggatttgttcaccgggcggcgcggctggtccatcgattatgtcatccctgcaatctgcgtgctggccatgatcgcaatggccgccattgcgattgttctgcgtctgcgcattgaagaatatatgatctatgtattgctcgacggcctgttcggcatcgttccgctgttgtttttaacgcttggatgggtgcgcgtatcgttcccttccattctctgcgtcgcggcaagcatcctgtcccttgccgctctgctttccttccagggcgaaacgctgctgtccgagctgcgccgccgcctgcatctctaagaacctgcaaggatcgatcaatatgaaaaagcttcttttcgcaatcaatccgcacgccggcaaaggcgaaatcaaaacaaaggcgcttgaagtcatcgacctgtttgtgcatgacggttatgaagtaaccgtgcatacaacgcagcgccgccgtgaaatcacccacctgctggccggccgcgccgcattgtatgacctgatcgtctgctgcggcggcgacggcacgctcaatgaaaccatcgacggcctgatgcgctgcgcgcagcgtccgccgcttggctatatcccggcgggaaccgtcaacgacttcgcttcaagccttgggatctccaaaaatattttacaggcggcgcataccattttgcagggcgtgccctttgcctgtgacatcggctcgttcggcgcgcggtatttttcctatattgccgcgttcggcgcgtttaccgatgtggcgtatcagacgccgcagcaatcaaaaaatatgctcggccgcgcggcgtattttctcgaagggatccgccgcctgccctcaatccatccttaccatatgaaactgacgcacgacagcggcgaaatcgaaggcgattttttgtttgggatggtatcaaacgcgctttctgtcggcggtttcaagctgcgttccccggaaatccgcatgaacgacggcctgttggagctgctgcttgtacgcgatccgaaaaacgccgctgaagcgaccgccatcattggggcggtgctggggcgtgatttcagctcgccctatatcacaacgctgcgcacaaagcaattgtccatttcggccgccgaggcggtcccctggacgctcgacggggaatttggcggtaaagttgaaaccgttcaaattgaaaatcatcacgctgcgatcactgtcctgacaaacccatcgccgcccgcgccgtaaccaatagacaaaagccgcccctttcaccggaatattccggtgaaaggggcggcttttttccgtctcccggacggctgtcaaagcctggcgcgcgcaaagacggcaggcaagagctaagaccccctgtattcacagccgaaggatgcagggcaggcggctgtgaatacagattctaaggcaggctgttgccctgaagcacaagcgcgcgcagcagcgccatgcattcgcgcacccaatatgacggcagcaggccccacggcgttgtagatgaaacagcggcgcacggctttaacccggcggcctgcgcatagatcgcaccgcgaagctggtgaaagccatctgtcacaatcaaaagctggcgcggcaggtcctcgtgtgtgatcagttcaccggcaaagcgcaggttttcgagcgtattgcgcgactgatcttccatatagatccggtcagccggcaaaccgcgcgcaatcagataatcgcgcatggcaaccgcttcgctgatcgtttcccctctgtcgacgccgcctgtcacaacaacgggcgtgtcagaatgagccgccagatacgtatatgccgcatcgagacgcaggcgcagtatctgcgacggcttgccattgacactctgactgccgagcacaacaactgtgtacgattcgccggcacgcggcggcataaaccaggcgtaacgaatcatcagcacggacagaacagcgccggtaagcacagcggccgcaagaacgaaagacacggccagacgcagccagcgccaccaacgggccgcgcgtaccggcgccgggcgcgccgcgccaaatgataggctgcggtgaatccgcggcgcgctttccacagcgggaaatgcatcccacaggaccgccagcgcgcacagcgccagcccaaataatataagcgtcaaaacgccggtgttaaacaccccaaagggcatcggcaaaatgccgcaaatcattgcaaatatcccaataagaaccgcgattcttttaaatgctgatttcataataggcctctgatgaaaaaatttcaacatgacagccgggcgcgcgtgacccgtgcgcgggtcactcaccgccggacgctgcgcttgcccggccggctttggcgcgcgcgacctgtgcgcaggccgcccaccgccgggaggcgcgcgcaatccgtgcgcggattgctcaccgccggacgctgcgcttgcccggccggctattcggggctttccggcggctacaaagacagcttcctcaacgattgcttcatgggtgttgcggaaaatcgcctgctgttcctttgtggtgggaatacgccttttcagcttgtgggatttggaatagcttttaaagtttaccgtatgcccgcagtagtccatgcgctccaaaactgctacaatcgtgctttcattccaactgtacggattatcgggaagtggtttccctttctgctttgcataatgggcgcgtgttgtcagcactttgtcagctttcagtattttcgctatccgcataggtccgtttccggcaacacataaatcaaaaatcctctttaccacagcggcggcttcttcatctacaatccatttctttctgtcgtttgggtctaccttatagccataaggcggcttagtcagatgttcccctgccatgccctgcgctttcttgattgcccgtacctttttactggtatctttggcgtaaaaatcgttaaacagatttcggaaaggggtaaaatcattgtcgccctttgcactgtccacgccgtcattgattgcgatatagcgcacatctctttcaacgaaaaagatttctgtatagtagccgactttcagatagtcacgccccaagcgggacatatccttgacaatgactgtcgccacatttccggcttcaatctctacaatcatgcggttaaaattcgggcggtcaaaggtcacaccggaaacgccgtcatcaatgaaaaatactggatttgtaaagccattatccgaagcgtattttgacataactgctttctgactatcaatgctgttactatccccgtccaatgcgtcctcttgacttaaacgggtatataatgcggttatctgttcgggtttatagttctgtttgtgtagaagatgtagacgaaaatgagatatttgtaattgatagaatattaattattgtttaaaaaaagtggctttactatcgggcggcaggaaataaatcaagctgaagaatatattgatgcgatttataaaggtaacaagctaaactgcaaaccaaaaatcaaagcctttgttgttggtgattcggtgtctccatccataagcacaaaaaaactcaagaggattatggagaagtttatgcctatacttataagcaattagtgcaaatggctgtaaaaagacttttcaatttaaaagataagctaactgtaagctatcaggagctaaatgctaaagactacttagccgagattttgggtgagcctcgtcagatgaatttgactatttcagaataattaataaaatacggacgcaccacgctttgataaaatggtgtgtccgtatttttaatcctgtatggcagctgccctatttcagtttgttaattgatactattttatgcgtagctaccctggggacgttctttttatatgcactctatatcaaaaccgcttgccgcgggaaaaacttggactgccctgcccgccggaccggtattccgcccatccggcgggccgacatgtgaaaaaagaggtagaagaaaagagagagaaagtaatgaataaaggctggagaatgtctttactttttatcctggaggatacaccgcctttccttttggagtggtttcagtataccggccgaatgtgaaatccgtttgaagtttttttgacggttgcttaaaacttccatggataaaatgcgaaaggcccccgccgttatggcagggacccttcgcgttgatatgggaaagaagaagtaagtcggcggtcaattttttgcgggctgcgtttcggctgggtccttgagaaccatgtgcagaaggatgttgagtacgacgccgcagacaaccgcgataaacacgttgttgttgacaaacatcttgacaaacgggtggaaggaattggcccactccgcgcctgtggtggagaaaaacacaggcagcatcaccgctgtgccgatggtggtcccggcgatcaggttgttgcgggcgtcgcgcgcttcggaaacgacaacgtcgatgccggagaacatgatcatactcgcagagatcaggaacacagcgccaacgaccggacgcggaatgcaggcgagcatctgcgcaagctttggagacaagccgtaaagcaggaacataaccgccgccacccgcacaacgcggcgggacgcgacgcctgtagcggccagaatgccgatgttctgcgtataacttgtgaccggcagcgcaccgagcagtccggaaccgatgcagccgagtccctcggccatgatgcccttgttgatatgcttgacgcggtaaacctgatcgcagaccgcacaggtagcggcataatcgccgattgattcaaagatcgagccgatatagccggtaaagcccgccaggatcgcggccgggatcagcacaaacggcgcggtcgccccttcaaagttgcggaacgggaaaagctgcggcagggcaaacaggtcggcctgaccgacaagctcccagtcgaagataccagcgaccgatgaaacaacgatgccgacgatcacaaccgaaatcagaacgaagccctgggacagcagccccttacagcggaatttaagcacaagcgccaacaaaaaggcaaccaacgccagaatcaggtagaccggctcatgcgaagcgaatatccagcctagggctattttagccgcaacaaagccgatcgtcgctacgaccgacccggtcacgacaggggggatgaatttgcgcaggcgtcccagtatacgggaaacgccgatgactgcttcaagcgcgccgccgacaagcacagcaccccacattgcggggaacccgtaggtggccgcgacgccgcccatcgcggtcaaaacggacgaggacggtccctgtacaaccggcaggcggtttccaatggtcgtctggagcagagtgcctacgcccatggcaagaaaacaggtgcggatcataatcgggagtatcgtttcagatagacctgccagcgatacaaacattccggcccagataaacggtgtgaagtcaacaagcgtaatctgccatgcaaaaaagagggtctgccaccagctcttggggttttcatcgactccgatcgtcacctttaccgtgctgtccggctgtttatcaaaaataggctgctcaggattatacattgcttttccctcctccggttgggcagccgtccggcagcggacggctgcggtttacacctgatggttacagcagtgaagccttgcgttcaaacgaagcgatcacgcggccgcggcgcaggatgtacggacgcgacgcgcgcgtgcgcagcgcctcctgaatattgtccgcatcgagcaggttgaggtctgcgtcgtttccgacctcgatgccatattttgcgcccggatcaaatattttggcggagttataggtgagcatatcaaagatcaatttcgcggtgcccggtgtattatactgtgcggtgtacgcgcctacaaggccgtaatcgagcggatcgcccgtgccgtacagatggaatccgtcgcagatcgtgtcctgcgcggtggcgacattaatgcccatatcgaccatctcgcggatgcgtgtgacgccgcgcgtgcgcggttcggcatcgatgcccatgatggcaagcacctgcgtattggtgcagatattcatacctgactccttgatcagcttcataaccttgatcgcgtgcgactggttttgataggtgatcgatgtacagtgtccgcctgtgacgcgcggtccccatcccttctgcatggtcagccatgccgtatattcaagcgagcggtcaaacatgtccttggactggtcgatgtgcatatcgatcgggacattgtatttttcagcgatttcaaataccaggtccacatggctacgcgcgtgttcgtcgagccattcggccgcaggcatgccgcccaccacgtcgcagcccatctccatggcctgccacatcagcttttcggtgccctcattggcataaataccctcctgcgggaaggcgatgacctgcaaatcgcagatgtccttgcaggcttcctttgcggccagcacaccctcaaggccgaccaggtttgccatattgtcaatgtccacgttcgtgcgcagctttgtcgtgccgtacatgacacactcacggatggcccgctcggcgcgcgccttcacatcttcgacggtgtagcgccgcttgatgtcgtgcatgatatggatggaatcctccagcgtttcgacggtactttcacggccggcgagcgcggtgtatgccttgtcaaaatgcatatgtgtgttgacaaacgtcggtgcggccagcataccattggcatcgatcacctcaagcccttcgatgccttcggaattgatgccgggtcggatttcagcatatttgccgtcgtccccgatcagaaggtcgttcataccgcgtccatccgcaagattcgcattgcgtatcaagagcatggcgtccactccttttctattttgttttgctttggaatgactccatcatagcaatccgtcattgcgatgtcaaattttttatgttaaaattgcacgtaattttatccttaaaacaacacttttttgccaaaaacaacttattaattgcgcaattaagaaagcctttgtttacatttcattttaattgctgtaaaataaatacaaaaaatatgcttatccctaaaaaaatctgatttttacagcgtcttatgattgacaggcaagaccatgcggaatataaaacgcttttacgcacggcttgaggctcaaggagggtgtgaagcaatgatcacgattcatgatgtagcagccgcctgcggcgtctccgccacaacggtttcacacgtgctgaaccatacgcgccctgtcgacccgcagacggccgcccgggtgcgggcagccgtcgaaacgcttgggtaccggccgctgcgcaaccgcgacaaatacggactgcgcgcctcccgcaccgtcggcttttttgcccacggcgctggaatcactgcctgcgccgacctgcttgaacgcctgcgcggccaggtgggtacacaatgccgtctgatgctgatctgcacagagcaatcgctgtccgacggtgaattgcgagccatgcaaatgttttaccgcctgtcgctgtgcatcctgcacaactctgtccgcatcagcggcgcgggcgtgtcctcggacgcctatccggttcccacgctgctgttaagcagccagccggcggacgcgcccaacctgcgctgcatttcgtttgattaccgccgcgcagcgcagatggcgctttcgcatctgatcggccttggacataccgaaaccgcatttctatccagtatgcacaacagcacggtcaatgatgaaatccgcgattctgtccgtgcttttctgcgcgagcatgggcttgcctttcgggaggattattatttcgagcttcccaccacgcccggtacagcgtccacacaggcagcgctcgactcgtttttcacatcccatccctccctgacggcggtgattccagtcggcgcgtgggcagcggcctgtatagccgattattttctgcggcgcgagctgtccagcccgcgcgacaaatcaatcgtcgccatcggtgggctgagtatcctggaggaatacagctcgcatatcacacgcgtcgatatgggcacagacagcctgctcgccgcgattgccgcctggatcgacgcgcagggcgcccgggacatccccgcgcgaatcgcgcccgtgttccatccgggcgccagcacacggacgctcgcccgcacaccggctggcgcgcccgcctttgcacccgagacgctggagctttcgtccgacgaattgcagcgggtgcgcgccggaagctttaccgtctgcgtctcgcttgacaacggcgacgcggcctttttccagctcgtgctgcgcggcctgcgcgacgccctcaccgatctgaatatgacgctgcttgaaacggctgaagcgcacggcagccttgcgcggcgcggctcgcagctgaagtatttcgcccatctctcgcccgatgcgatcatcagcttttcaaatgaccagacgcctttgcgcgatcaattcgtcgcactggccaacagccggtccaagctcattctgggcgtcgacatgccgcccgatctgccggaatatgcctgcgcgtcctgcgtcgccaccaacgagccggaaaaaggccggctggcgggacgtctgctcgcctccgagctaattcgacgcaaaaggcgccgcgtcggctttatctgcaacgcagacgtgaatttctgcgcgcgtcagcgcgacctggctgctatcagtacggtgcgcgaggattttccgcagctcgagatcgtctttcgccatgattttcttaacgagcgccaagccgcggacgctgtgcgccaggcacttgacgcatatcccgatgtggacggcgtctatatcttttccgcgcgcgccgctcttgaggcacagcgtctgctgctcgcacgcggccgcggcgacgtgctgcttgtcaccacccagatcaatgccgaaatcgccggtatgctgattgaatatccgaatctgcttgggatcatctcctcgcagggctatgaaatcggccgctgccttgcgcttgcggccgccgtcagcctgattggaaagcagccgccgcgctatgtggcgctcgatcccgtcaccattaccgccgggaatctggagcgcgcctgggtgcgcacggcgcgtttaagtccgccggcgcagtaagaagcccggacgcgccgcgcgcgtccgggcttcttgtttgaggaagggcgcctacgcctgcttattggatgtgcgcagcagtgtgcggtatttatacgcaaacagcaggcagcaggttgtcgcggccgtgatatccgcgattggttcggccagaacaaccccatccgtggccggcgttatgaaatgcggcaggatgataacaagcggaatcagcaggatcagcttgcgcagcaacgcaataaaaatcgacaccttcgcctgtccaagagcgataaacacttgctgcaaggccaattgtacgccgaaaatagccatccccagaaaaaagaccggcatgatctgcgcggccagctccacaacggccgggtcgtcggtaaagacgcgcacaggaagctttggaaaaaacaccgcgacaccccacagcagcagactgaacgccaggcagaataccgcgcagtactttgcagccgacttcacacggtcataattgcccgcgccgtaattaaagccgatgattggctgcgcgccctgtgcaaaccccataaccggcatcgtaaaaaactgcattacgctggacatgatgacgatggcgctcacatacaaatcgccgccatacgactgcatcgacgtattaaaggcgatctgcacaaggctctccgtgctctgcatgataaacggcgacagccccagtgcaagcacacttgccatcacacgcgggctgatgcgcagatactgaacgcgcaggcgcagcgtgctccgcgtggaacagacaaaccacagcacccaggctgcggaaaccgtctgtgaaataaccgtcgcgagcgccgcgccgcgcacacccatatcgcaggcgaaaattaaaatgggatccagaatgatattgagcgcagcgccgacacagaccgtcgccatcgctgttttcgcaaagccctgcgccgatatgaactgatttaagccgagcgccagttggacgctgatggtcccgatcagatagacgctcagataactgtccgcataggggagcgtatcgtcgctcgcgccgaacagacgcagcagcggcgtcttaaaaagcagaagcagcgtcgtaagaaccagcgcgagcaaaacaagcatggaaaagcagtttcccagcagccgctgcgcttccgcgcgcttgccggcgcccatgcggatggaggcgagcggcgcgccgccaaagcccaccagggctgcaaacgccgaaataatcatgatgatcggaaaggtcagccccacgcctgtcaaagccattgtccccgtcaccggaatgcggccgatatacatgcggtcgacgacgttataaagcgcgttgatgatttgtgcggcgatggccggcgcggaaagcgacagaatcaacctggggatgttctcattggcaaatcgttcgtccatggactgcttcaatgctgttcacccgttcgtacaaagtcatactaacattttatctatcttatcacaaaagtatgaacagattatgtatgcacacaatatcagtgactgctgcatttcccgggaaaaaggtatgctgaaaaactttagccggctgcgcgccggcctttttgaaaaaaggcctcggcgaaaaactttagtcggctgcgccgcgaacagtggggtgggttctgatatttatactggctgcgccgcgaacagtggggcgggttctgatatttatactggctgcgccgcgaacagtggggcggggtctgatatttatactggctgcgccgcgaacagtggggcggggtctgatatttatactggctgcgccgcgaacagcggggcagccgctgcataaagacaggctgctttcatccggcgttcagccgtcgatgtggatgttgacgccgttgacctcgacgccgtcgttggcgcggatcaggatgtatttgcatccattgatgacgcgcgtttcgaccaggtcgctgcgctgcgggttcacatggatggtaacgtcgggcgtgcgcacctcgaactgcttctggtcgacgatgttgcgcggcggcaaatccgtatcggcgccgaacgcgtcgtcataccgcgcgtcaaacgcttctatgttttcctcggaaacgccgcaggactttaaaacgttcttgaccgtgtactttgaaacggcaagcggctcgtccacatggttcgccttatgctcctcgatcatcccgcagagctgctcgtgaaccgtctgcatgacgccaaggctgcaatcgccttcgagcgtatcctccagaatttcctggaacgtctccttctgaacggcggccgccatcggcagtgggcggcagaacaccgcgtccacaaaatcctgattcatctgttccgtatcgcgtgaataataaagcgcgccgtacaggtttgcgctgcggtcgtcaaacgccgggaacagaaagccaagctcgggtgcggcgacaatccaatccgccttgcagttgcggaatgtattttcattgacataatagcttaaggcgggctttgtcatcttgaccgggcaaacgctgcaaagaatgtaagaatacacctcggccgccgcatcgtcaagctgttgtccgtccttggcgcgatagggaacgtcatatgtatcgtgcgccaacaggatcaggtaatttccgtcaaacgaaaccgcctgtatgacgtgttcataaaattcgcgcaccgcctgttcatcgcaaagcgaggaacttcgcagcgccatcagcaggcggtgctccgggctgtcaaccacctgctgcgttgcaaacgcgatatcgatcagatttttcccaagcccgcctgacagcgtccgcttgaggatggcgagcagcttttcggcctcctcctgcggcatcagggcgagcgactgtgaaaattcagagacaatctcccgtttttcgttgatataacagccccgcacatgggtgatgttgcttttgtccggtttaaaccggcggcggatttccgcaatttccttctcgttcatacgatcctctttccgtaataagctttattggttcggtctgttttacagcaacattcagggcggcagcgggccgcgcccgcgtatcgccctggccatggaagaaaaataaccgctctgcggttattttagcatgtccgcaaagcggcatgataaaattggccttcagggcggcagcgggccgcgcccgcgtatcgccctggccatggaagtaaaataaccgctctgcggttattttagcacaaatatccctccgcaacaaaccgaaaaaaggcagcccctgtatccctgcccaatggaacaggcttatctttgtagaaacgcacaaaatttcctgggaatgcttgcattgcctgtattggggttgtatcataattttatcgttgcggcccacgccgcggcgcagggtgtggcagatacgccgtgagggctgttttgccatgcttttttgttatgatagaaacggcgccgcccattcggggcgaagcgctacggagggaatggatacgggcaaatatattctggcgctcgaccagggcaccaccagctcgcgcgcgatcctgttcgatcatgagcagaatattgcaggcatcgcgcagaaagaatttacgcagctttacccaaggcaggggtgggtcgaacacgatcccatggagatttacgcctcgcagtatgcggtgatgatggaggtcatcgcccagacgggcgtgaacgcgcgcgatatctctgccatcggcgtcaccaaccagcgtgaaaccacgattctttgggaccggcagacaggccgcccgatctataacgcgatcgtctggcagtgccggcgcacagccggtatcatcgacgcattaaaggaaaagggcctgtccggttacatccgggagacgacgggcctggtcccggacgcttacttttccgggaccaagatcaaatggattctggatcagacgccgggcgcgcgcgttcgcgcgcgcaggggcgaaatcctgttcggtacggtggatagctggctggtctggaaactgaccggcggcgcggcgcatgtaaccgattatacaaacgcctcgcgcacaatgatctataatatcaacacgctcgattgggacgatcgcctgctggacgcgctcgacatcccccgcgcaatgctgcccgccgtctgcgacagcagccgtatctatgggtatgcagaaatccagggcgcgcgcattccgattgcgggtatcgccggcgatcagcaggcggcgctgtttgggcaatgctgctttaagcagggggaagcgaaaaacacctatgggaccggctgctttttgctgatgaacaccggcgaaacaccctgtatcagcgataacggcctggtcacaacaatcgcggccggactgggcggccgggtacagtacgcgctggaggggagcgttttcgccggcggggcggtcatccaatggcttcgtgacgaaatgcgttttctcaccgaagcgcgcgacgccgaatattacgcgcaaaaggtggaggataccggcggcgtctatctggtgcccgcgtttacagggcttggcgcgccctattgggacatgtatgcgcgcggctgcctgatcggattgacgcgcggtacgcggcgcgaacatatcatccgcgccgcgcaggagtcgatcgcctatcagagcgccgacctggtgcgtgcgatggagcgggataccggcgtccctctggctgaactgaaggtggacggcggcgcctcgcgcgaccggtttttgatgcagtttcaggcggatatccttgataaacgcatccgccgccccgttgtccgtgaaacgaccgcgctcggcgcggcgtatctggccgggcttgcggtgggcgtctggagcggccgggaggaaattcgcagactgtggagctgcgacgccgccttcacgccggatatggacccgatccggcgcgacagcctgctgcgcggctggcataaggcggtcgggcgcagtctcgactgggaagaacatacataaaagccgaaaggcccggctgtctttttaagacagccgggccttgtaatgttttatggcggcgggcggcgcttcaatccgactcgtcgcggcggcgctcaacctgccgcagtacctctgcagcgtcgcgcttttccagcgcgccggcaaacgctgtcacatgccgtcattacgccggcctgaaccgcgtctttatgccgggcagccgcgaccggtttgacaactcatcctatgattcgcccgctaagatggaccggcaggtcatttcggatatagccggctaacttctcagccaactgtaagccgcatgccggaaggatgcatacaagacctggacatcccctgcaaaagcgtgcaaagccttgccatacaggcgcagatatgatagaataatcgatggaataaatacatatgtgcgccgatcgcgtacatttaaaggggattttcttatggattatatcagcacgcgcggcggccggccggtttcggcggcacaggcgatcgtgtcgggccttgcgccggacggcgggctttacgtcccgcagtcgctgccttccttttccctcgatgaaattgcgtcgcttgccaagcttggttatacggggcgcgccgtcgaggtgctctcccgctttttaacggactttacgcgcggcgagctgacggaatatgttggccgcgcctatgcaaaaagcaagtttttgcccgaggctgtcgcgcctgtcgtaccgctcggcggcgacggcgcgtatatccttgagctgtttcacgggccgacctgcgcctttaaggatttcgcgctccagcttctgccgcttctgctgacggcttccctgaaaaagacaggcgtggacaaaacggtcgtcattctcgtggcgacctccggcgatacaggcaaagcggcgcttgaaggtttcgccggtgtgccgggtacaaaaatctgcgtattctatcccgacggcggcacaagcagcatccagcgccgccagatgacgacgcaggcaggcgacaacgtgatggtgttcgccgcaaaaggcaattttgacgacgcgcaaaacggcgtcaagcgcatttttaccgacgcggccttcgctaaggctctctctgagcatgggtatttgctctcgtcggccaattcgatcaactggggccgcttggtcccacagattgtctattacttttccgcctactgcgagctgctgaacgccggacgcatcaaggctggcgatgcgatcgacgtcgctgtgcctaccggcaatttcgggaacatccttgccgcgtggttcgccaagcacagcggcctgcccatccggcgtttgatctgcgcgtcgaaccgcaacaatgtgctgaccgacttcatcaaaaccgggacgtatgaccgcaaccgtgatttcttccttacgacctcgccgtccatggatatcctgatctcctcaaatctcgagcgtctgctctatctgttctgcgggcgcgacgacggccgtgtgcgcggctatatgcagtcgctcgcaaaaaccggctcctacacggttgaacaggatgtgcttgcccgcttgcaggcggaattttcagcgggctgcgccgacgatgcacaaacggcgcagacgatccgagacatctgggaaaagacgggttatctgtgcgatacgcatacggccgtggccgtgcatgtctgcgaacaggcacgcggcggcgacaaaacgccgattgtgattgcttcgaccgccagccccttcaagtttgccgccagcgtcctgcccgccgccttcggcgtcgcgccgcagggcgacgatttcgcgcagcttaacaccctttccaaagcgtccggtctgagcgcgcccgacgcgttggccggattgcagggccggaaggaacgttttttgactgtcgtcgcgcccgccgatatgaagcaggccgtcgccggctggctctcgcttttttgaaaaatagcttggcaaaaaactttccggcctttttgaaaaaaggcctcagcgaaaaactttagccggctgcgccgcaaacagtgggtttggtgctgcataaaagtaggctgtgccgcgaacagcggggcaggtcccggcgtttttacaggctgcacctgtcccgtgaggcgcgaaaaggggcacagccgcggcttgtccgcgcccggcgctctggcgccggaaagccccgaacagccggccgggcaagcgcagcgcccggcggtgagcgacccgcgcacggattgtgtgcgccccacggcggtgagtgatccgcgcacgggtcgtgcgcgccagcgcggctggcggggctttcagaatcgccggctttgccgaacaggcgttatgccgccgcaagctgtatatcccccagataagccggactatttttaatgaatcatcaggagaagcatatgaaatatattgtcatgcttggggacggtatggccgaccggccggtccccgcgctcggcggcaaaacgccgctggaagctgcatatactcccaatatggattttttggcgcaaaacggtgtgacgggtatggtacgcaccgtgcccgaagggatgccgccgggttctgacacagcaaacctttccgttatgggctatgatcccaaggtctattacagcggccgttcgccgctggaagcggtgagcatgggcgtggagcttgcgccggacgatgtggcttaccgctgcaatcttgtaacgctttcggatgcgccggagcttgaggacgccgaaatgatcgattattcagcgggagaaatttcgaccgctgaggccgccgatctgatcgcctgcctcgatgcggcgttccatgcggacgactgcacgctgtatgccggcatcagctaccgccattgccttgtgctgcgcgggacgcagacaggaagcgactgtacgccgccgcatgatctttccggccagccggtccgcggacatctgccttccggccgccatggtgcgcgcctgcgtgaaatgatggagcggtcgcgtgcgctgctgcgcgatcatccggtcaatcaggcgcgcatcgctcgcgggctgcggccggcaaatgcctgctggttctggggagaaggtacacggcccgcgctgacgccgtttgagcagctctatggcatgcgcggcggcgtgatttcagccgtcgatctgatcaagggaattgcgatctgcgcagggcttgacagtatcgatgtaccgggcgcgaccggcaatatcgacacaaacttcgccggcaaggggcaggccgcgctggagctgctgcaaaacggtcacgactttgtttatatccatgtggaggcccccgacgaatgcgggcatcgcggcgaagcggaaaataaagtcgcttcgatcgagctgatcgaccgtgaaatccttgggtgcgtcttgcccgccctgcgcggaagcggcgaagccttttccgtacttttgatgccggaccatccgacgccgctgtccatccgcacacacacagccgatccggtgcccttcgcgctttaccgcagcgacaccgtgccggacgcacattggcgcgcgcctgcctataccgaagcgcatgccgcttccaccggactgatgatccccgcggggcatcgcatgatggaatggcttctgcgcggtcaaatgcccgaaaattttgccaaaagctgttgacaagcagccgatcggatggtataataattgagcgtgatcacactgatgacgtgcaattgcgggtatggcggaattggcagacgcgttagattcaggttctaatggtcgcaaggctgtgcaggttcaagtcctgttacccgcaccaaaaaagaatgcccactttggataccatcggcagaaatgccgatggtatcgggcttttcggggggtttttcacctcaaatttcacagctaaaacaaaagatccaaacagggggttcacagaagctggctggatccgaaccccaaaattctatagaaatccacagcgtcctttttgaaatgagatttttcaaaaagggcgctgttttcatatcccgaaaaagggcgctaaagttacaagggaggcaaagagatggaaaacaccaatgtccggcaggaggaaatccgcagccgcttcttcggtgaactgtccctgcagctgcgggaaaagggcatcgtatcagagaggaagggcacaaacatcctgtgtgtgtatctggacggggaacccgtctgcgacgtccaccctaccagcaacgtcttcagctgtgaaggccgcaaaaaatccgaggaggctaacgagctccaatatgaaacagccaggatcgcgcacacggtcagggcgtacctcaatgagttggaagccgcgccccctcccccctccaaggatcttgactccgaggatggttacaagcatctggccggctttggcgagggctttgagcagcgggcaaatcaggcgccggacggcgagatctatgcccatccgtggagtccggacggcgactggagcatccagaccgagcaggagctgttcggttccaggctggaccgttatgaggaacagaagggaggaattacccttgggtaaaaaaatcttcgaggtagagatcagcaatgatgggccaaggggatatgaaacggccaccgagttggagctgcccgcgacctgggcggagtttcacgacgcgctggagaaggcccggattacggatgggtcctgctgcgggattgaagcgactgagatccaccacaaggagatttccgaagcggatcttgggaaagtcaaaaacctgtatgaactcaacctcttcgcccagcgcctctccatgctggaagaagatcaggcatgcggctttgagggactgctgcagatggaacgggacagccggaccagccctatccccctgcaaaggctgatcgacctgaccttccataccgactcctgcctcatagcgcccaatgtccacaacatcagtgacttgggcgcctatttaattcataatgggatgctgtcggatgcggcggccagcctgctggctgaatctgatgagggtagcgagtttcaaaacgagctgctggcacttctgggaaaacggcatatggaggaaaacgcaggcgtattcacatcatatggttatgtggaaccagacggcggtgaatgggaggaggcatatgcccccggcaagatggcgtattttacccgaagcggcgctcctgtggcgctggaggttggaaaagcggaagatcatggcagcgggctgtctgctgttttgaatctcccggcttgtgaagctgctgtaaatcaggcgttcaataccatagatatcttttgcaaagaatacttcgttcaatgtgtggactgcctgatccctgccgcgagggaatggatcaacgacgcggtccaggaggcggacggtattaaggcggcaaatgaattcgcgcgtcagctcgcacagaaagaacgggtatgggacgcggcggagtttaccggcgtcttaaaggaagaacctctgcccgactgggcaagagagaagctggagcggctgcaatctcatgagacgcagccgccccagctttccatgtgaaaggaggatttttacaaatgagaaagatcaggacgcctttgctggccagcctgctggttttgtccatgagcgtcaccgcgtttgcagagccgccgcagacggttatcggcgcggacgggaatgggaccagcatcaccatcaccgacatcacccccagagaggacgaggagaatgagcagaaagcagagcggaaaacaaactacaaggtggggagcttctatcccatcgagatccagaccgcagaggaggatagaatccgcctgctggtcaagaccttccttgtgccgcagggtacagaccccgcggctctcgtcgaggaggggatgaccagaggggtggcccacttcgcctacaaaacagccctcagggagcggcagtacgcagtcagcaaaatccgggagatcccgcaggacaactgggactacctcatgcgcactgaggataaacgcctcacactcattacctgcatcaccggcaagcccgattcccgccttatggtgcaggcggtcgaagcttagtccctctttcttgttggatttggtgatagcttgcccttgcttttgctggtatcctttgtggcaaaaggaggctatccactatgaaaaaaccctgagagcaatgctcatctccgtcatgctgctggcctgcgccgtcaccgcccatgccgcgctctctgaaccggaggggtatccggtcaccgtcaacgactggaccacccccgccgtcttcgcggccggcaaagattggcccatcaccacctggtacctctatgctgaggatgatacggtgctggggagcatccccaaccggacggtgatggagcttgcaaaacagcatcccaccggcagcgtgcagtgggaaacctggctggcggaagcctttaacgagtaccggcagatcagcagctttacgcagaacagcaaagcagaggaaaaacagctggtcatcgaggccggcccgccgatagaatccaacgaggattttgacgccgaagccttcggcctcatcaataaggcgagggcggaaaatggcctgcatgaagtgaatcaggacgaggaggcgatggagctggcaaagatgcgggtccccgagctggaggagcagtacggccacatccgcccggacggcacccggatgtcgcagacctaccggtgcgcagagatcatcaaccgcagggcgtccaccccacagctcgcggcggagtcctggctggactcgccggcgcatcgatcatcctggatgtgcggtaccacagcgcgggcgtcgcctgctggaagggtgcagattacgtcgcctactggtggtgcatgctcttctacaaataaggccagccatgtcgtcgccggtccccgaaagggggcctttttttgttatgaaaacattcagccagaagggcacaacaacccagcccgcccagagggcaggctaatggacagtataagttgttgcttcaggcggagccgggcagggcatcaggttcccagcccagtgctttcaggcgtttcaggtaaccatgtatttttctgtccctattaaaagaatcgtaatagtcagaggccaaatcacgaaatggcacgttgcttctaagcatgtggtatatggcgattaacatggaatgagcaacagcaagtgtagcacggttcttgccccgccttgcggcgatccgctggtattgcaccgagaaataagccccttttacagaacgtgcggattttgcacattgggttaaaatcgtcttgagcagcatgtttccgtttatcgtttttccgtgctttctccgtcccgcgctctggcagttgccaggacaaaccccagcccaggagcagagatgggcagcactgggaaatctgctcatatccaggccgatttccgccagaaacacctcggcgctgcggcgggcgatgccgggaatatcgcaaagagcgataatcaccgcttcatattcatccatgtaatcctgaaccagtttgtccaagtcggcaatacgtctattcagatcgtcgatatgatctatgacctgcgccagccgctttctttgcagcggtgtggtgattccctcgatggccgtcacaagttgtcccagtttggagcgcatccgcccgtggatcatcttggatatttcctcctcactggttgggacatcatcttcaatgatttttttcaacagctttctgacactttttccgttgatgtctttgaccacagaatccaatttgatgttggcgccctccagaatcttttgtagacggttgctttctcggcaccattcctctgtcagactttttcggtaacgggtaatttcacgtatctcccgctgtccccggctggggatataacttgctttcagcagtccgtggcggagcagatccgcgatccattctgcgtctttcatatcggtcttaaggccgggcagtgctttcatgtgcgccgcattgacaactatggcatccaaatccatggtggggctgtccagggcggcccgttctgaaatcagccctgccgccgttttgccggtgaaggcaaagcggagcttgttctgcacaaaggcatagaatgcctttgtggtttctctgtttttgtcgtagtcgtagctgcactgttcaaacacatccgcgatcttttgataggcccagcgcccgctggcccgaatttcgcggatgcgctccggtagctcgttgaagtagtcccggccgaagggcttgctgttttttagcatgtcatcattgaggacaaatcccttattgatgtactctttcgcgtttttgtagcccactggcggaatcaggtggcttttttagagttcacccggtatcccacgacaatgatggcgtccagcttgtagtgctccaaggtgcggcgaacctgtcgggcgccttcttgacgaactaccgagaatttctcggtagttgcctgcggcgtcagctcatcttccgcataaatatttttaggtgtagagagagcttgtctgttgtgcagtcaaatagctctgccgttccactttgtgtgagccataaagtttcttcctaaaatacaacgctgacaaactctttctcgccgttgttttgatagagcaggatttcgccctgttgcataggaacagattccataaataccccctccctatcataattacagataacattgtaactttattttcaataaaagcaagtgtaaataaatgcagggaggacagcggatggctgccctccctgcggtttacgtggacatgggcgaagggaagtctttccgggcttggacttcctgctctgccagacggcggcggttatagagcagcagatatcgggtctgctggaatgatccgattctcaagataaaaaaccgcgatcagatagttctgcgttttgtactgctgatagacgggtttcagtgattcttaaaaagccgcgtcatttttccgttcgggtcagccacagcccgacaattttacgctccttttgtacgtgcatgtacaatgggccattatttccttgccaatagttccctccatcttgttaaaagttatatacctaggaccaatcctggtatttcatttactggctaactatctgaatatgattgtcagtgaacctttgggagaaccattgccggaatccttcgactccactccgcaggagtgggagttcgtccgcctgcttgcccaactgtttccagagcagcaggaacttgtgattgcctcgcttcatgggattctcgatgccaacggccgcagtaggcacccatgtttttttaatgtggattattcaaaaaacaccgccggcgacaagcgcaccatgcgcatttccgtcggtggtgttttactatgtatgtgcaagatttctccgggtcactccgattggcccagcaattctgttgccgttttatcatacccgctgttggaactcatcaaatgatcaaaaccttccagtttttattccagttccagacacagggtgtatcgtttctcttaagaaggaaccataagcaacctcatcataacgcaggaagctcataccaacagaagcttctttcccatatgggacagcttctgcgcaatagattcttccaactcgttaccgacaataattgtatcaatggcatccaggccagcaatagaaaacatggcgcgggactggaacttggaatggtcgcaaaggagaatgcgctctgatgcattggcgatgccgatttttttaatattgagatcatccatggtatagctcttcagacccatctccggatcgatggcgtccacagagaaaaagagcttgctgactgtaatattgccaagcatggtttctgcaaaaaatccataggaggagcagaagcccttccgtatcatgccgccgatcagcagaagggatagatcgggaatatcctggagttcagctgcgatgcggatatcattggtgacaaccgtcaaatgggattttgatttgagaagtttggccagctccagaacggttgttccggaatccaacataagcttgtcaccgtcatgaatatactccagtgcagctaaagcaatccgttgcttttcttcagagttgaccaggcttttggccacaaaggatggctctgctgaggtagcctccacattacacgattttgctccgccacgaattttaatcagcaaattctgcgctgacagatcgttgatatctctcctggctgtagcctttgaaatacggacttcctccataagatcttccaatgcaacgatcccttttttatttacaaaatcaacaatttgctggtagcgttcagcacgcagcatgatgataaatcacctcggcttcatagtcagcggtagaatactttcaaagcttccacagctcgctgatatagacgatacttattttggtaaataagatggcgaacggcgtttggaatataccgtttttggatgtggttcatggatttggcggcagttggcagatccgagtatgcgccgacagcggcggcggcgcacatggcgctgcccagagcgcctgtttctgtggattccaaaatctccagaggaatacccagaagatcgcacaacatctgagaccagatggccgaacgtgcggggccgccggacaggcgggcagtcggaggaagcgagtgagggcaaagtctgtgtacatgatccatcatggagaatacgatgccctcgtataccgctgcaagcatgtgacgcagcgtatggtgactggaaagattgaaaaaacatgcttttgcaccagaaacggtattggaactgtacagataaggtaaaaaaatcaaatcactggatgcaggatccacgtctgctaccatctgattgcaataatcataggcagagctgccgcagaggtctttgccggaaagaagctgatccaaaaaccagtcgagattgctggcagaggtcgggctggcttcttcccaaaatgtcatatccgggcggaaagagcaaagcgcggtactggtgccgggaatggactgctcagacgggataaggcggcagcagattgaccaagttcccatgacaagacacagccggctttcatccagaacaccagctgccagacaacacgaggcggcgtcgtataatccagtggctacaggcgttccggccaacagtcccgtgcagactgcggcttcttgggagacggtgccgcacagttcagctgaaccttccacagggtaggaaaaaaagctatgcgcctccggtatgtccagagccgcaaagcaatcaggatgaaactggcggcgctgcaaatcaaagagattggtattggaggcatcggtggcctcagtagacaatctcccggtcatgcaaaaccgaatatagtccttgatggagagtacatgggtaaaattggagtatgtgtgcggatcgtgccgcttccaccaggggagcaatacagcagcctgaccggcccaaagctgctggtgggtatattgaaagatctgctgtgccgtcccgttttgatcataaagctgcaacagatcattggcacgggtatcggtagatacgatgctgggaataaccggcgcgtactgatgatccaacacggtaagcccgccgccataaccgcaaaagctgacacaggcaatccgggctggagctatggcggcggattccaatacggaacgaatcacccgacagtttccttcccaaatatgttctgcgggccgttctgtttcaccgtgactgccgcgctgcattgggatacgggtggaggccgaggctataatatggccgctgcggtcgcaaagaatgcacttggtagcggaacctccgttatcgattcccataaaataatctgtattcaaagcaattctccttactgttggtgaattgcagcagcagatacttaggatcattttacttagattatatcagctgtgatgcaatttggcaataaaagaaactgaactgttcaaaacaatacgataagcgggctgaggataatgcacaatacgttcgcctcagcccgcaacttgcatccgcctcacaaaaaaagatcgtctgctgtgcagaatattacaatgttttgcggaactcctttacaatatccataaactcacggacgcgggattcgtctaccgcattttcaaatacaccatcgtatttgaaggtggtagcgcatacagcgccgtcggaatgagtcagctgacgaacgatattgtctttgttgcagccggtgttacagagaatgggagtatgcttgacagatgccttgacgcgggaaagaacctgcgtatcggtttcgctgccggcagtcagaccggaaacacaaatggcgtcagggcggttgttgaattccgtagagcgggcgatctcctcaatgggacgatcagccagatattgggcggcttcgggaacgatgttgaacagcagtttgatctgctcgccgccaatggccatttgatggcgaacggtctgaccgacattggtgttccacaggccaaagtcggaggcgtagacaccgctgataatttcacggatgaatttgccgcccacagcaacgcacaggtccagagaagcgatggggtcccacaggcagttgacgccgtagggaacacggatttcctcgtgcagcgagccgattacccagcccatggcggcaatggtgatgggctctacttttgtcaggtagggaaggctgaattcattggagaacataatgccgtccacaccgccgttttgcagagcatgaagatcacggcgtgcgcactccaatacgtaatccattcctttttctttattataatgaggatctcccggcaagggctgaaggtggcacatggcgataatgggctttttgactccgaacaactcttccatccagttcattaaaatccgcatcctttcaatattatgattataattgatgggttttgtatgtatatacccatttgcacaactgtattgtaacataataaatcaaattatgcaataaataaatcataaaacatcaaataattgagctggtcaaattgcacaaagattatccactcaaattgtaccctatatttttaaaaaataattgcaaataaaatcaaataatggtattattgtaacataaatcagatgaaacagagagcgatgttgatttataatgattttaattgaaccgtcattggcgtctgcagatcaattaaacttacagactcacattgacaccctgaagaatgcacctagtctccatcttgacattgaggatggcaactttgtgcccaacattacatttggtttaaaaacggttcgggcagtggcaaggtatgccaagcagaggctggatgctcatctgatggtaagccaaccggaaaactatgtattggatctgttgcaaatgggtgtacattcgattgcgatacatattgaagcggggcagtatcctgcggtgcagctccaagcaattcgaaagggcggtgggcgagctggcctggcctttaactgtatggcgcccattgaagcaggcctggcgtatcgggaatggatagactatctcctgattatgacatcggaaccggatggaatgggacaacggttcaatgagcatatcctgcaaaagatatcccgagcaaggacgctctatggtccggaaatggagattatggcggatggcggaatcggtgaggaacagatggcggcggtagccgcatgcggtgcaaatgtgattgtgatgggcaggactatttggaatgcaccggacccacaagaacaatacggcgtgttgatggaaaggttacagagatatggtgaacaataagccggtttttggcgtatatgaaaaggcgctgaggctgagaagccttgagaagctatttgatacagcggcatcctgcggctacgagacctttgagctgagcttggacagcaccgatcaacggatggccagactggattggaatgctgcagaacgtcaggctgtacgcaatgcggcatccaatagcggcatcaagcttctcacgacctgcttgagtggcggaaaacggtaccctctggggagttcaaatttggagctggtgcacaaagggctggaaatgacggaaaaagccattgccttgtgcggagacctggggattcgggtgattcagctttcaggatttgatgtatacgatcaggagccgcggacggctgagacacagaaacgatatgtagagaatctgtttcaatgtgtgcagatggcggaaaaagcatgtgtgaccttggcgattgagccggtggagggcaatttgctggccgtccgcgatacaatgcaggtaattcgcgccatcaattcctgctggctgcagctgtatccggatgtcgccaatatcaattcgctgggaatcgacccaattcgggaactgccctatggcgcaggacacattgtggcagtccatatgcgtgattcgatcattgactgttacgatgccaccattccatttggaaccggctgtcttgattttgagggcgtttttcgacagttggcggatatgaagttctgcggccctttggtggtggagatgtggaatacggaggcgccggatgatcgggagcgaatcattcaggccagaacctatatggaacagtgcattgagaaagtgagggaacagcatgtgggaagcggaaaaggctaaagtgctccaggcggcattggaaatcaaaaaaaatggtctagtctccctgtccggcggcaatgtcagcatgcgtgtaggggaggaccggtatttggtcacaccatcaggtatgctctatgagaatatgacgccggaggatgtttgtgtcattgacggccaggggcgtttggtagagggcacacgcaaaccgtcctcagacgccagtgcgttgctgtacatgtttgatcacatgccaaagatccatgcgattattcatactcaccagccatgggctacggcagccggctttgatacggacgaactgccggagtttttggtcacagtcatagatgcctgccatgcgccggtcaaggtggccccgtttacgccgtcctctgccattggcatgggggttctagctacggaatatgctggagatgctctggcagttattttaaagcaccacggtgtgctggcatacggcgccaatctggatgaggcgctgttttccgcaatctatctggaggaggcggctaaaacctatgtgctggcccgggctatgggatgcggtatcccacagctggatccggcgctgatcgctcaggaaaaagccggatggcagacctacggacagtgaggcgcaaatgaaaaacagggtatcatcctacggcggatataccgctattggactggatttcggaacgcgggaagcgcgggcgcagctccgcggtctggatggaaaactgcttggagaagctgtgttttcctatccccacggtgttatgagcgaccggcttccggatggaacaacgctgcggcctgtggatgcgctacagcatccacaggactacatagacgcgctgcacaccctgattcccgcgctgctccaatctggagatcccaaccgcgtggtgggcgtgggggtcgattttacacaatgcaccatgatgcctgtgggggaagatggcgcgcctctgtgtcaaacggaacagttcgccaatcaacccatggcctacgctaaactgtggagacaccatagcgcacagccgcaggctgaccgtatgacgcaggttgcacagcagcgcggagagatgtttctggcctattgcggagagagcgtctatgcagagagtatgtttcccaaaatattggagacattcgagcgggcgccgaagctctaccaggcggcagatgcatttgtagagctggcggactggataccctggtatttgacaggagaacgccgccgcagccgcagcatagcaggatgtgctgctctatgggacccgacggctgaatacccttcctttgactatttagaggcggtagcgccggggttcgggtctgcgctggacaaattgcgcggaccgctggtagcagtgggacgctccatcggcggcctgcttccggagcgggcggcacagttggggctgccggcaggaattccggtggccgcaggattgggggattgtcaggcggcttttttgggcgtcggattgtatcagccgggggtactgctcagtgtgatgggaacctccagttgtgatatggtcatccattcagaacgaattgccattcccggtatgtatggaatcagcagtgacagtatgatcccaggttactacggctatgaggcgggacaggctaccatgggagatctgttccgatggttttcagagcagtgggtgccgaaggagattgaagatgctgcaaaagtgcgtggagaaacggtttttgattttctcaaccaccggattgcagcgcggcagccggctgccagcggcttgctggctttggactggtggtgcggaaaccgcaccgttcttttggatacggatttgagcggtctgttggttggtatgacgatgaacaccacatgtgaagatgtatatcaagcgctgatgcagtctttggcctttggaaaacgtcgaattgtagaacaatttcaaaactatggtattcctgtggcacgtatgcgggttacaggaggtgtggcggaaaagaatcccgttctgatgcaggtgtttgccgatgtgttgaaaatgccggtggaggtttccgacgaggccaacggcagctgtaacggcagctgcatttacggtgcattggcaggaagcggctttccgaatatggaactggcagcagcagccatgggcggcggcgtatcccgtgtttattatccgactccggaccgaggcaggatgtacgaccggctatatgaactatactgtcaactccatgatgcgttcggaacagagacatcgatcatgaagcagttgaaggcaatgcaggcagaggagggaaaaaagtgaaatttggatgtttttcgctggattttagaagatttccgttggaacacgcctttgctgcggcacagaagtatggatttgacggcttggaaatctggggaggaaggccgcacgcctatccacaggatgtcacatcggagctggcagcgcaggtgcgacgctggaaaagcgtatatggcgttgagacccccatgtatacgccggtcagcattggaatgccttataatctctgtgcagaaaatcagcaggaaagacaggacaccttggcatattttcgcaaagcgatagacggctgcgcagccatggagattccgaggatgctggttgtggcggatcatccaggatatacggtccggcggcgagctgcctggaggcaatttgtagaaaatctgcatatacttggaagctatggagcgcagcgcggtgtccgcctggtgatagagccgctgacgcccatggagagtccagtcattacgaccgcagatgactgtgcggacgctctggaagagatcgggcttgacacggtggaagccatgctggacgtggtgccgccccggattgcccacgaacctttatcgtcctactttaccaagctgcgcggacgtatgcagtatatccacctgtgcaataacgacggcagaacggacgcacatacccggctggatgtgggagaactgccggtggaggatattttgagtctgattacacaatatcggtttgacggctatgtgacggtagagctctattccgaaaactacagagatcccgaactgatgctggccaatgccgccaggctgctgcggcagtacagtaaccgattagatccggaaggtcaagggtgagtatatgagcgagtatgttctggagctaagaaatattgtgaaacgatttccgggtgtggtggcgctgaataatgtacagttccagctgaagcccggagaagtacatgcgctcatgggtgaaaacggcgcgggtaaaagtactctgatcaaggtgattaccggtgtacataagccagatgaaggagaaatcctggtaaaagggcagccggtggtctttcagaacacaaatgactctgcagcgaaaagcattgcggccatttatcagcacagcacagtgtaccctcatctgagcgttacggagaacatctttgtgggacatgagcggcggaacaagctgggcctggtggattggaagcgaatgcacattcgtgcaggagaattgctgcggagcctggggtcaggcattgacccgcaccggcggatgggtgaactcagcgtggcggagcagcaaattgtggagatatccaaggcggttgccgccaacgcggaaatagtcattatggacgagccaacagcagccctgtccaagcgggaatgtgaagagctgtatcggattacagagcagctgcgcaatgagggaaaatccataatctttatttcgcaccggttggaggatatgtatcgtctggcagaccgggtaacggtattccgggatgcaatgtacattggtacctgggagctgcgggagttgaccaatgagctgctggtgcaggctatggttggacggacgatcacagatctctatcccaagaaaaaggtgcctataggggaaacaatcctggaagtgaagaatctgtgccaaacgggcaactttagaaatgtttccttttccgtccgccgcggcgagatttttggcctgaccggcctggtgggggctggacggtcggaactctgccaggccatctgcggcgtgacaacctacgagagcggaacggtaatcctgaatggagaaaccgtccggtttacccatccgctgcaatcaatgcagaagaagctgggttaccttcctgaagaccgtcaggttcaggggttggtgctggattggtctattttccgcaatattaccttgccgtcactgagaaaatacagtacagcggcaggattgaatagcaaacaggagcgccaggacggagaagcgttccggaaaaagctctccatccggaccaaggacattgatgagaaggtcagcgccttgtccggcggcaaccagcagaaggtcgtatttgccaagctgttgaatctggatctgaacgtactgattcttgatgagccgaccaaaggtgtggatgtgggtgcaaaatctcagatatacagcattatgtcggatctggcagagcagggatatgcgattatcctgatctcctcggaaatgccggaggttctggcgatgagcgaccgcattggtgtgatgcacgagggcagcctggtaaaaatcctggaccgaaaagaggcgacgcaggaaaagatgctggcgtatgctatgaactcggcagacaccatgctgaaggattaaggaggtgcggcaagtatggaaacaaaactggtgtccggacgcatccggcgctttttgcatgagcgcacacagcaggcggccttgctgggcgtcattctgatcgtaagtattctcgtacagctgcgcacgggaggcagtttcctgacggcatccaatcttaatgagatgatgcgcgaggcatccatgctgataattgtttccgtgggaatgatgattgtcattgtgggcggcggtattgacttgtcggtgggttccgtaatgggtctgtccggaatgatcgcagccctgacgctgcgggccaatccgcaaatgccggtgattgcggtctttctggtagccatgggcgtggggctgatctgcggcgtcattaccggctttgttgtggcggagctgcgcatatttccactgatcggtacgttgggtacatgtgatattctgcgcggtgtgatttattggttcagcaatggcgaatgggtcgggcagtccgacatgacgccgggctttctgtccattgctacagacaaattgcttggcatcaactgcatggtatggtttgctgccggcgcagtgatattcggaacgattctcatggggcatacccggctggggcggcacatttatgcggtgggaaacagcgaacactgtgcgaaaatttctggtatcaatacggtaaaggtaaagtggatttcgtatatattcagcggtgttcttgctggtttagcgggtgtgctgtgggtttgcaaatatgccaatgcacagggtactacggcaacaggctatgagcttaacgtcattgcttctgtggttttgggaggtgtcagcatcaagggcggcgcaggtacgatttttggtgtggtacttggttcgctgctgttcggcatccttaataatattctgccattgattcaggtttcttctttctggcagagagccattcgcggtgcggtgattctgctggcggtgattatcaactcgttggtagcccgcagagcagctaaaagagcaatggaaaggagagaaattgatgagacagcgtgagcgaaagcaggaaaacacgttgcgtcaaaagaccgggtggctgtttgctcagtgggagacgctgctggtactgatctttcttctggtgaatatcatcaatattaacctctctccctattatttgaactatactaatttgatgaattccatgatcaacttcatggataaaggattgatggtattcggcatcatgatggtgctgatattgggtgagattgatatttccattgcatccatcattacgttatccgcctgcacagcaggatgggccggcgaactgggggtgccgctggcgggatgcgttttggttgctttgctggtcggcgcactgtgcggcgcgttcaacggcgttctgctggcggcgtttccggaattgaactccaccatcgtgacactgggcacacaaatcctatatcgtggtctggcgtatatgctgctggaggatgaatcgctgaagacctatgcgaaacaattgtcggatttggcttgggaacgaatattcggtctgcctgtgattctggtggcgtttattatcctgtctgtgatttttatgtttgtcatccatcgaatggcatttggccgccgtctttacgcgttgggatccaattacactgccagctatttttcaggcattcgcacatcgcgcattaaaattatggtatttaccatcagtggcctgtgcgcgtcttttgcgggcctgttcctggcagccaagcttgcctcggttcgcgccagcattgcccagggatatgagatggaagttattgctatggcgattctgggaggcgccagcccatccggcggaaagggccgtgtaggtggtgtgatcgttggcgtgtttaccatcggtctgatccgatatggtacagggttggtcaatgtatctgcggaaacgctgaaggttattatcggtattcttttgatcgtggtttgtgcagctcccaatatgaaacaagtgttggcggatgcaaaggaatccagacgaggcaaacgtcagcttgtaataaaaaaaggaggaacctgataatgaaaaagatcttagcacttacccttgctctgtgcatgctgtttacttccatggtaggatgcagcagcggatcggataccactgcggccggcaccggcagcaatacatcaacagaggctggaacgacccagccggataccggtgatgcggaagccagcgaagaaccgacagagaccaacgatgatccgacagcggatttacaggtcagtgaagatgctcccacctatgtgatggtgtccaaaacgctttcggacccagtgttcattgatatgtatattggcttccgggagttctgtgagagcattggtgcaaactgtatgtaccgtggttcagatgaacctacggccgaaaaagaaattgagattattacacagctgatggcgcaaggtgtggatggccttgcagtaatcgctgcggactttgatgcgctggaaccggtgctgactcaagccatggggcagggaattgctgtagtgacatttgactctgccgctaacccggattcccggcagctgcatgttgagcaggcttccatagacctggtaggccgtgatcagatgaagtcggctttggagattattggaggacccggcgcagaagggaccgtcggtattttgtcggcgcagcctgagtcccagcttcatgctgattggtgcaacgccatgctgaaagaagtggaagacaatcctgaggactttgccaatgttacggtgctgcccattgcctacggcgatgatctgccggacaagtctaccactgaagcgcaggccatgctccagaattatcctgacattgatgtcatcattagtcccaccactgttggcattctgtctgccgcgaaggtcattcaggatttgggttcggaatgtaaggttaccggtgtagggctgccttctgagatggctccctatattgaaagcggcatttgttatgattgctatctttggaatccctacgatcaggggtatttggctgctgcttctgtcaactccatcagtacaggggaaagcacaggcgctgtgggcgatacggtgacggcaggccgccttggagagtatactgtagaggagtactacgatggcggcacacaagtattactgggagaccccattcggtttaccaaggaaaacattggcgagtataaagatttgttctgattttcaaatcagtaattgcccataaaagagtatttgctcctccatcgctgggcctgcgtacaggcttaacgatgggggaacatctgttctgcaaacgggtacttcgcttgcaaaataaaggagccttgatggtgttttggcatgcaatgattggtctatgtaattccagacattcttattcacagcaggagatgtcaggaaacaacaacggtgtgaaatcacgaaaggcccgctgggttaccccagccgcggcgctctgccagatccggcagtccaaaggaaaaccgctctgactgtatccatgtagtctgtgatgggtcccctccagagatcgtcccaggcggccggccaaaaacatcggcgtaccagcgataccagcagggacggagaaaaggtcacaggaatgaggtgatcattactgaggacccaacgatttggaatcgaaattgagatgaccggcatcacaagggcggcagccgcccgggtggtcgccggttattttcataccacagcgcttcatgcaggcgggatctacgatacctatacggtgcgggatgagcagaaccggcagtggaaactggtcaaagattcctctattcaatgtgaaaatcgcagcggcgacccggttggcggggcctatgcggtagaaatggtatctcccatctgtgtctatgaggacatcgtcgtcatccaggagctcatccgcaagctgcaggaggcgggcgcgaaggtcaacaattcctgcggcatccatgtttatgtggacgcctccgcccacactgtaaccaccctgcgcaacatcgtcaatatcatggccgcaaaggagatctgctctacaaggcgcttcaggtgaacgtatcccgagagaaccactgccaaaagcggatacccggttccttgacgatatgaaccggcagcgcccccgctccatgcaggagctggaacagctctggtataacagacccaacgggcagagtgatcattacgattgcaccagataccacgccctcaacctgcacagtgtggtggctgatggcgaggcggagctggatatatgccttgatttttttcgcgtggagggtggagttgaacagccggaattcaatggtgcccttggagaacacacgttggagcagaaacgcgcgaagccaacccgaacccataacagcaatgagaaatacaccttccgcacctggctgctccggctggagatgatcggtgacgaattcaaaaccgcgcggcagcacctgctgaagcatctggaggggaatatcgcctggcgggacccggaataggcacaggcgcagaagaaacggctggcagcgcagcagctggcagagagggagcgcgtgctggaatgggaacaggaggaaacagacccctctgaaccagaggaagaagcggctataacaatgaccatgcgaaaggatggatgagaaatggaaaaacggctctatgtcgcatacggaagaaacctgaatattctgcagatgaagcagagatgccccactgcaaagctatgcggtaccgggacggtagaaaattatcagttgcagttcaaaggccgcccgcaaagcgccttcgccaccatctccccaaaggagggctcctctgtcccggtggcggtttgggagctgcagccccgggacgaacgggcgctggaccggtacgagggatacccttctcactacttcaagcaggatatccctgtgcaactggacggtaaagaggttgtcgggatggtctacatcatggatctggaaatggatcacggcctcccttccctcgcctactaccagacggtacaggagggatatgaggactgctggcgtcggtgatgatgctgatcgcggagttttgcccgtccgaggaacggcacatcgtgtcggtattcaagctcttgcaggatctccttgctcccagcaaggtcaagggcaaaaaccacttccagcttttgatggagcagctcccaccggaacacaaggcgcgatggatggcgggggcggcgctccacaccggggagcaggccatgctgtcagtcctctccaccgccatgagccgtctcaacgcctttctggacaccgagctggaacagctcctctgctttgacagtgccattgatgcggagcggttctgtaaggagaaaaccgccctgttcatcgtcatgcccgaggaggatcccaccgcctattttctcgtgagcctcatcatccagcagctctactgggagctgatgacggtggcggatgaaaatggcggcaagctgccccggcgctgtatcttctatgccgatgagtttgggaccatcccaaagctggagggggccgagatgatgttttccgccgcccgctcgcgggggcttaccatcgtggcgattgtgcagggcctcatccagttggacaaaaactatgggaaagagggcgcacaggtgattcgggacaactgccagctcacgatcttcggcggctttgcccccggcagcgagacagcggagacgctctccaaagaccttggggaacagacggtgctctccggctcggtgagcaagggcaaggacaataactcccgcagcctgcagatgatggggcggcggctgatgaccccggacgagctgaaaagcatgcccaagggccagtttatcaccatgaaaaccgggatgcacccgatgaaaaccaaatttggcctgttcttaaagtggggtatccgctttgggaagcagtttgaactgccgtaacattccgcccgcaagatacagtatgccggacgggagaagctggcggcggctatagcgcggcaatatccgaaagcagatgacaagtgtgagaggcttcccttagaagaaattcctgtgcgggaagccactgcaaaatcttcccgcaggcatccgcctcgtaccgaatgagaggagggattcattgcgtagactggaacaaatctatggggacaacgcgctgccccaccgggtaaaagccgtttacatctatctgtacgaccgggcggatcgggagggaaaaagctggccctctctttcgaccatttccaaagatcttgcactctccagatccaccgtcaagcgggccatcgccgacctcaaggcggtgggatatctggaaaccgagcagcgatggcggcgaaacggcggcaggaccagcttgctttttaagctgctgaaatgattgatggctgaaaaaatcacagtccacaccaagggtgaactgcgcccttgggtggactgtggtacggttcgtcatgggctgaggaaggggaacttcccactggaaggataacgatgaacagagagaataatgggttctcccataatggttcgcgctaatcttcatttagacgtattcatttccgttcctctcctgctcctcctcccccaataagcaatcggatatggttgtgtgaccagattgttttgtacagcttttctaacggttcatcggaaactgtatagcccgcccgtttgagcaatgtaaccatgatttcatatccagctaaataatagtattcttgggaatcctcaatggcgctttttcttctttcaaactgcttgttaacttcctcgcgcgcctctggcggaagctcttttataaatgattgacaaacctgtatcaattctgttccttatccgcatgaccaggaatttgtttcagatcgactgttttaacaatctgttcgagcagatccccagccgcacttagaaaaccttgtgcaagataataatcgttgatgagttcttcataatcaataaaagcatctgtgacagaagaatagctgtctcgcaggtcgtattttttgggacagagacaggaagaatgataatgctccctatactctcgatagatagaggagtaccgcttctgatagggtatcactatagaggaaagttcgcccaatataccttctataaattcttctgtgattagatgtttttgagacattgcgcggccccctttctattttaacgtgtggcgctcaatctcctgcgctataataccccggatgctgatgtatcttcatctaactattaccgcacacgggaatagacgggtatttttattgctatcataaagaaaatactgtatgagtattaactaaatgatagcaggtagaaaagatgaatgaccaatattcacagattatcgtcaatcgaatactgtcattatgtcagcaacatgatttcacgatatatcagctatctactatgagtggcattagttattcaacactggataaccttataaagtacaagacattcaatcccaaaataaagacactccacaaaattgcttctgcgtttagtctcacattgtctgaattttttgattaccctgaaattgaaaatttttcatttgatgatagcaatgattaggagcgagaaacggattttgattgcccctcaagtaatcaagatgcagttcaacattttctatttatcgtatcatgttaggtctagggtgtcaatgtgattcgactaatattattgattttatcatcgttttagactacgccaatgtattacaatattattggggtggttttatgtcggcagatgaagcctttgactttggattacgattacgccaactccgagaagatcgtggaatgtcacgattaactttgacaaaaaagttgggtgtaagtaaagaaactatttatagtggctaatgaggtaacaccatgtataaaagcccaaatggttatgataatatcattttgcttttcttccgaatagtgcgtctgccctaataatttacttacaatatttttatagataatataaggtttatagttttggtcgtctggtattgataatgataagtcaatttttatgttggattgagaatataaaaattgaaaataagcagggttttctacaaagaaagatacataggctatccccatatctttcaaggaaaatcacttttccaacccacaatttttcgtggacgacggttacagtggtacgagttttgaacgcccctcttgaacggaactcattgaaaaggtcgagaacggcgaagtagcaaccttgattgtcaagtatatgtcgcggcttgggcgtgattatctggaagtgggattttacaccggagtcctgtttgtggagaaaagcgtgcgcttcattgccattaacagcggtatcgacagcgtaaaccaacaggatagcgacttcaccccgtttttgaatatcataaacgagtggtattcaaaagatacaagcaagaagatacgcgctgtgatgaagtccaaaggggaagcaggcgaacacctctgtaccaatccgccctacggttacatgaaagaccccgacaacaaaaagcattggattgtcgaccccgaagccgccgaagtagtaaagcgaatattcgcgctctgcttagagggctacgggccgtcgcagattgcctgtattctgaaagaggataaagtcataacaccgactattcattttcagcggacaggcagggcaacgaggaacacgctgccggacaatccgtatcactggacgggcgacaccatcgccgacattttagagcgtccagagtatcaggggcgtacggtaaacttcaagacctacaagcagtcgtacaagagcaaaaagacctgttacaatcccaaagaaaagcagcttgtgtttgagaatacccatgaagcgataattgacgctgacacatggcaacgggtacaggaattacggaagaataaacgccgcccgacaaggacaggcaagaaaaatatgttttctggcattgtacgctgtgccgattgcggtgagaagatctattactgcacaagcaggaactttggagcaaggcaagaccattttgtttgctctacttcaaggctgaaaggaaaagaggtttgcccgacgcattttatccgcgccgttgttttggaacagggcgtactcgcccacatgagattgacgattgcctgtgttgcgaaccacgaagaacaattccgcaaagctatgggcgcgaagcagaaagccgaagcaaaaaaggaacttgcagcaaagcggcggcaactgacacaagcggaacgacggatagaagaacttgaccggctattcaagcgtatttacgaggataacgtaggcgggaaattatctgacagcagatttcaaatgctctctgacgattacgaataggagcaggaagaactgcaggaaaggctgttgcgattgaatgaagaaattacaaaacaggaagaacaggcagaaaatatcgacaggtttataggcaaagtacagaaatatctcgacttggacgagctgacgcccgctatcttaaatgacatggtaaaggcggtatatgttcacgcgctggataagtcaaagggatatagggaacagcagattgacatttcctatgaccttgtaggaatactccccgcgcctttgctgaatagcttgcaaaacggcgaaacggcatagccgaagctacgctgtttccctaaacattcttatgctgttttatgagtgccgccctaagggacgttcttttttgcttgaccgcgtatttgacaaagctttctggaaatcctatacttattttaatcttactatgcaaggagctgcaaaacaacatgagcgaatgtacgcacgactgttcaagctgtggcgaaaactgcccgagcaggcagagcgatcccgctgattttctggaggcgccgaatgaattaagctgtgtgcgccgtgtaatcggcgtcgtcagcggaaagggcggcgttggcaaatcccttgtaacttcgatgctggccgtattgctcaagcgccgcggctacaatgtcggtatcatggacgccgatgtcaccggaccgtcgattcccaaagcgttcggcatccatgaaaaagccgcctcaaccgggaccgcgctcatccccgcgcgcagcaagacaggcgtcgatattatgtccgtcaacctgctgcttgaagatgacagcgatcctgttgtctggcgcgggccagtcatagcaggcgtggtaaagcaattttggaccgatgtcatatggaacgacgtcgatttcctgtttgtcgacatgccccctggaacaggcgatgtgccgctgactgtgttccagtccataccggtcgatggaattgtggtggtggcttcgccgcaggagcttgtcggcatgatcgtggaaaaggccgttaaaatggcgcagatgatgaatataccgatcattggcctggtggagaacatgagctatgtgcagtgccctgattgcggccgccgcatcgagctgttcggcaaaagccatattgacgaaacggccgcgcgttacaagctgccggtgctcgccaaaatccccatcgatccttcactcgcctccaactgcgacagcggcgtgatcgagctgttcgagggcgattggatggacgccgccgccgacgccgtagagcagtttcacgcatgacgattccggcctttttgaaaaaaggccccggcgggcgcgcgtgacccgtgcgcgggtcacagcggcggcgtccgctcgggcgtcctccgccttcgcgtggctttccgaagcgcggcaatcgccgcgcttcgggcgcagacaagctgcggcagcgccacgcggcgcgcctcatgggacaggggcgggccgcccctatcccatggacctacccccggggcaggaaacagcttgatgattttaccacggaacgtaccggcgtgcaaccaatacgatcgcgccaaacagaggtggggataccacaaggggagggccgccggccctccccttgtgatgtgcgaaaaggggcgcagccgcggcttgtccgcgcccggcgctacagcgccgggaagccccgaatagccggccgggcaagcgcagcgtccggcggtgagcggcctgcgcacaggccgcgcgcccttcctccggtgtgcgtttactttaaccggacatagatcagcttgacgctgctgtcgcgtgtgcggacgcttttgatgtcgaacaggccaagcgattcgagaaaaggcgtcagcttggaatgcccaaaattgcgcacatcaaaatcgggatggcgcttgacaagcagattgccgatggtgccgatgaacagccagccatcctcgtccgagttttccgagacgatcatccgcaacgatttccgaatggttttcaggctggtcatctctttggcggccgatgggtcagcttcagcctttgcgttttccctggccgcttccttttccatatgcgccggcgcgggcttgtccgcatccttcttattggcgggccgggacgcgtcctcgcgctggcagtcctcatccttttgcacggccggttcagcctgcgcgagaatatcgagatatttaaagcggttgcacgcggaaataaacgatttgggtgttttgcgttcgcccatgcccacaacaatcatgccgctttcgcgcagacgtgccgccaggcgtgtgaaatcgctgtcggacgagacaatgcaaaaaccgtccacctggccggaataaagaatatccatcgcgtcgataatcatggcggagtcggtggagtttttgccggtggtgtaattgtattgctggatgggcaggattgaattgtcaagcagtacgcttttccatgaaacgagcgcgggttttgtccaatccccatagatgcgtttataggtcgcaataccatcgtttgagatttcatccagaataattttgatatatttgtccgatacattgtcggcgtcgatcaggactgcaaatttcagatcgcttgccaagaaaatccccctttgccgcatgagcggctttttattaagtataacacaaatttgtggtgaatggagcggttttacagcgcgggggaaaatttttcccggaataccattgggctttgggctgaaaaacccaaagcttttttgcagcccaaggaaaacccggcaaaaaaaggccccggccgcacgcagctgcgcgcggccggggctgtatggtttgctttactgcaattcgatctggcgcgtctgagactgcgccggcgtccgcttaggcaaatcaagctccagtacaccgttgttataggcggctttgatcgcctccgtatttatgttggagacatcaaagctgcgggcaaaagaaccatagcggcgctcgcggcggacataaccgtccttgtcctcgctcgtttcggcattgtgctgtgccgaaatcgtcaacgtttcgccattgagatcaattttgatgtcctgcttatcaaagccgggcagctctgcctggagcacataccggtcgcctttatcaaggatatcggtgcgtatttccgaaaaaccagccgggaaatcgttaaagaatgttttttcaaacgtatcaaaaaagttcgctatatttctggtcttgtgttcaaaaggcatcaggtcaaacataaatcaaaacccctttcaaaaaaactgctgctttttcctgatctatgcggtatactgtctgctttatcggtggatattgatccgatacattgcaaccatcttccttctgtcctctaaaggactttctcttgtttcattgattacagtatactggatgattgttacaaaaccagacatgatttatgaatagatttgaaattttagcaatcttatatgttgagtgctaatcaaattgagaggccggatagcacctctgagagcgcggcggcggaggcggaaagcgcgcggttttcctcggtgttcagcgggaagtccagaattttttggataccgctgcgtccaacaattgccggcaggccgagacagacattatgcaggccataatggccatcggtcagaacagacacaggaagcacggaacgctcgtcacgcacgattgcctcggcaatacgcagcaccgccatggaaatagcgtaatttgtagcgcccttgttttcaatgatgcggtaggcgctatttttcacctcgtcaaacagtccgcgaatgccggacatatcggcgcattttccacagaccttgcaaaaatcaatcaaatcgatgcccgaaacattggcgctgctccagaccggcagttccgtatcgccgtgctcgccgatgataaacgcatgaatgttgcggggatcgacctccaaatgctcaccgagcagatatttcaggcgggcagtgtcaagcacggtacccgagcctatgacgcgctgcgccggaaagccggacagcgtgagtgtgacgcgcgttaaaatatccactggatttgcgacgatcaacagaatggaatcgcggttgcgccgcgtaatctgcggcacgatcgactggaaaatacggacgtttttgcgcacaagatcgatgcgtgtctctccgggcgcctgggctgctccggccgtgatgacaatcatgcccgcgtcggccaaatcgggataaccgccggcatagacgttgaccggccgcacaaagggaacgctgtgcgcgatgtccatcgcctcgccttcggcctttttttgatcgatgtccagcaggaccagctcggaaaacaggccgctttttaagagagtaaacgctgttgttgcaccgactgcgccgcaaccgatgacagcacatttttgcagattcaagaaatcgcctccttgtatttttaaacctgtgatcagttttccctgtgaggcagtccatattcagacggatcaaaagagactgcgccaaatccactgttcgcggcgcagcctgtataaacgcggtgctaaacccgctgttcgcggcgcagccggctaaagtttttgccgaagcttttttcaaaaaagccggaagcggcagcctgcaaaatccgcgtccaaccgcgcggcgcctgtcacggattttgcttaggacgggcggagcgccccggcaggtatcttgcggcctgcgggccgcgcttttatgagggctgcggcccaaagatcagggcgctgccctcgaaaaaaggcaagacccgcaaggggccttgccttttttctcacccgccgccttttgaaaaaggcgggcgaaaacttttgatcgacgcggcgtaaaactaattatgcagcagctaccccacatttgcggcgcagccgactaaagtttttcaccgaggccttttttcaaaaaggccggaaagttttttgccgagactttttttcaaaaaagccggaaagttttttgccgagactttttttcaaaaaagccggaaagttttttgccaggcttttttcaaaaaagcgaaagcttagaaaacggggattacggtgccattgtatttttcattgatgaaggcggctgtctcgtcgctctgaagcgcggcgatcagcttttggatttcgggacggctctcgtcgccggcgcgaactgccacaacattggcaaattcctgcgcggcctcggaatccttgtcctcagtcgtcagcacctggccggcaagaccggcaccaagcgcatagttgccgttgataacagccaaatcaacgtcaggcagcacgttgggaacctgggcggcctcaatttcctcaaacttgatatttttggtgttttccgtaatatcgagcggcgtagcggccagcccgacaccgtcggccagcttgatcagcccgagcttttcaagcagcagaagcgcgcgggcttcgttggtggcgtcgttggggaccgcaatggtcgcgccgtcggccagggcttcgatagaagccgtcttgcccggatagacgccgagcggctcaaaatgaattgcaccggcggagataagatccgtgccgtttttctcgttgaaatcagccagatacggataatgctggaagtagttggcgtcgatgtcgccttcgtcaagcgccatgttggggatgacgtaatccgtaaattcgacaatctcaagatttacgccctcggcggccaaagccggtttgatgctctcaaggatttcggcatgcggcgccggggacgcgccgaccttgatcgtgacggcgtcggcaggaacggcggaagcatccgccgccgcttcggaggacgcgacggtggcagaggcggcagcgtcaacggaggcggttgcttcggccgtggacggcgccggggcgggcgcggacgaggaagcaggcgcggcggacccgccgcaggcagccagagagaacgcgcaggtcagggccagcgcggacacgaacagttgtttgatcgatttcatatgtttgagactccttttaatcaaaagatttctatcataccggaagcggccgcattccggcgatggatgaatgaatcagcggttgcgcttatcgacgcgcgccgcaaggtggtcgaagatgatttgtatcaggcagacgatgacaatcagcagaatgattgtcaggatcataaccttcggctcatagcggtgaaagccatagcgcatcgcgatatcgccaagcccgcccgcgccggccgcgccggccatcgcggaatagccgatcagtgtgatggtggtgatcgacagaccgcggatcagggagggcagcgactccgggagcatcacgcgcaggatgatctgaccattggtcgcgcccatacacttggccgcctccacaacgccattgtcaatttccgacagcgagctttccaccaggcgcgcaacaaacggcgcggctgcgatggtcagcggcacgcaggcggcggctgtaccgatgatcttgcccatgatcagccttgtaaacggaaagagcgccaccatcaggataataaacggcagagaacgcaggatgttgacgatccagccgaaaacggaattgaatacacggttttccataatgccgccgcggtcggtcacgcgcagcagcacacccatcggcaggccgagtatgtaggcgcagacggttgaaccgagcaccatgacaagcgttgcgccggcgccctccagcagcatgggaccgtatcgctgcaaaagctccatcattctttcatcacctcatatccaagaagctgctttgtcatatcgtgtttggggttcttgaaaatctctgcggtgtcgccccattcgacgaattcagaggcgtcaatcacagcgaccttgttgcagatggcccgcacaacggcaatttcatgtgtgataataacgatcgtaacattcagcttgcggttgatatcatgcagaagctccaggatgttttttgtcgtgagggaatcgagcgcggaagtgggttcgtcgcacagaagcacctccgggcttgttgcgagcgcgcgcgcaatggcgacgcgctgcttctgaccgccggaaagctgcgatggatagctgtcgccgcggtcggccaggccgatcaggtcaagaagctccttgacgcgccggtcgatgtcggctttggcggcgtgtccgagcgtgagcggaaaggcaatattttgatgtaccgtgcgctgcatcagcaggttatagccctgaaaaacaacgcccattttgcggcgcgtttcgattaaacgcgtgcctgaaagcgacgcaagatcggttccgtcgagcgtgatggaaccgctggtcggcgtttccagtgtggacagacagcgcagaagcgtcgatttgccggcgccgctcatgccgatgatgccgaagatatcgcctctgccaatctcaaggttgacgccgcgaagcgccaccacctctcctgacttatcgttaaatatttttgatacgtcgctgatttttatcaaagcaatccctccaacatcccgctcgcatcgcggcaggaacaacaaaaaagccctcgttcccggacaaattgtccagggacgagagcgccgcttcgtggtaccaccctgcttcgccgccgcatttaagcggcagcctcaccggcgtccggctcgataccgaccgcctgtcgctttaacgggcgaacccgccgcggactaaaagctttcgcccgcgggactccaagaccatgttcggctgtgtttcccgcgcctcttttcaccaaccgaggctctctgctgcggttccgacagcctactcttcttttcagcgtctttcacagttttttgcaaacctttttgtagttgctattatactgcttttttacgtttcgtcaagaggaaaaagctgttttcgttgtaattcccatatgggtatgataaaatgggcttattagcggtcattttgtaaaaaggaagcaagggggtttttaaatgtctgaccgcagcgcggcgctcgcccggctcgacgcgctcggcgtcgcctatgagctgacggagcacccggccgtttttaccatcgaggatatggagcagttggggctgaccggcagcgggacggtttgtaaaaatttattcctgcgcgacgccaaaggccgccgtcattttttggttgtgatcccagggaattgccgcgccgatcttaaatcgattgaaacgcagctcggctcgacaagactgagctttgcgtccgcggagcgcctgcaaagatatctggggctgattggtggagaggtgacgccgctcggtattatcaacgatccggacgccgccgtcgaagttgtattcgaccggtcgcttgaaggaaatccgcgtgtgggcgtccatccgaacgacaacaccgcgacggtctggctggcgttcgatgatcttttgcgcattgtcatggacaatggaaacacagtgcactttatcacactggaaacagccctcacatgacatgggggcttgtttgaaaaatcaaaatacccgtttttccggaaaacagcggcgaacgctgtgttaaaaagcctgggaatccgaaaggattcctgcgttttggccatgcgcccgcctgctgtctgcgaaagatcaggctattctctattttctaacaagccctgggcctgcgggccggaaaggggaatgcatatgattaaaaatattatttttgatatgggaaatgtgctgatgcggtttgatcccatggcgctggcctctcatttcgccagcagccaggaggatcaaaagctgttatgtgagcatgtgttctccggaccagagtggtatgcgcttgacgcagggtccattgatgaggaggatgcgctttccagtatcctgtccatgatgccggatcgcctgcatgccgcggcagaggaggcgtttcgcggctgggaccgctatttcggcccgattcaagagacaaatgattacgcgcgttccctcaaagagcggggctataagctgtatctgctttcaaacgcaggcgtgcgcttcgcgcgctaccgtacgcggatacccgtatacgactgcttcgacggcgtgattgtatcagcttatgtccggcaggtaaagcccgaccgcgcaatttatgaaacgctgttttctacatacgagcttgagccagccgaatgcttctttattgacgacaacgaacagaacattgccgccgcacgggactgcggtatgcaggggttggtgttcaccggtcccgacccccttccgtcctttcccccgcttttttgaaacttaccttttttgaaaaaaaggtaagacaaaaaactttagtcggctgcgccgcgaatagtggggcgggcgctgcgcgtatacaggctgtgccgcgaacagcggggcgggtggtgcgcgtatacaggctgtgccgcgaacagcggggcgggtggtgcgcgtatacaggctgcgccgcgaacagcggggcgggcgctgcgcaaaaacaggctgcgccgcgagcagcggcacggctccggcgctgaaacgggtcacgctgcaaacggtgaaaataaaaactgcgtcccgcataaacgggacgcggtgcggctgaccgtccgcctttacggctggaacaaccccttttccaccaactcgccagattcgttgaattcaagctccataacgcgtgagcgtgtgtaacgaataatgggacgcaggcgcggcagctcgtcgcgcccgtagaaaatataggacaccccttcctttttggcgcggcccgtgcggccgatgcggtggagatagtattcgttttcaagcgggatttcgtaattaaagaccgcgtcaacatcgagaacatcgataccgcgcgctgccacgtcggttgcgacaaggatgctgatctcgccggaacggaaccgggccataatctggttgcgctcggattggcgcatgtcgccgttgaggcaatcggcattgaagccgcgttcacgcagcaaattgctcaggcttgcggttgaatatttggtattgcagaaaatcatgaccttgtgaaaatcgttcgcctcaaggatgtaacacaggtcggcgagcttttggcggccgacgctctcgagcatatactgatggattttcggctggctttccttgaccggctcgaccgtcagctcgacggtgtcgcgctgataaagccaaccgatatccattacctcgcgggaaatggtcgcggaaaacatgaccatctgacgctccttcggcaggcgatccaggattttgcatacgtccttataaaatcccatgtcgagcatctcgtcggcctcgtcaagcacagcgatcgacaccttggaaaggttgatcgtgcggcggtgcatgtggtcaagcattcggcccggcgttgcaacgacgatctgcgcgccgcgctttaaggcgttgatctgcctgtcgatctgctgcccgccgtataccgccgcgacccgcacctgcggacgaaaatgcgcaagctcgcgcaattcgtccacaatctgcgtgcaaagctcgcgcgtcgggcagagcacaaccgcctgcacagccagagcagacgggtcgattttttccataatcggcacgccgaacgcgcacgttttaccggtgcctgtcggcgccttggcaatgatctcgcgcccttcaagcatgacagggatcgccttttcctgtatttcagtcaactccgtaaagcccatgcgctccacggccttcaatgtttcctccgaaagcaataaatcgctgtactgcgccatgttctgattctccctttgtcctgtgcaggcctccggctgcatttttttgcataccaccccgattatagaaatagtataccacacagcctgtctccgcgtaaagggctatcagtgtggtgaagcatcaaattacaaaatttttccgtatattcgctatagggcttcattctgtggtataataaccgcagagcggttattataccgggttatgcccagcggctcgccgcttgcgcggcaaccgccttttgctaacggaggtaaaacataggaatatgaaaccttattgttatttgtatttaagttgtcctgttgttttgcacaattgaagtgtatttatttgtgcctttcaccataaaaataacaaaacccatatataacgatgttatacatgggttttgtctaatttggtggagacgaaggggatcgaaccctctacctcttgaatgccattcaagcgctctcccaggtgagctacgcccccatatggtgacccatcggagattcgaactccggacaccttgattaaaagtcaagtgctctgccaactgagctaatgggtcgcccccggcagtcgaccagcacgttgtctgtacgacgcttaattattatagcaggggaatataagcttgtcaactatttccggggaattttttaggaatttttgcagcatacacagaaaccccgataaaatcgatgtttgaacgcttggaaattggcgacatccgtccatggagacaggcgtgagcagaagggtggtacgaattagaggctgtttaaaaaattaaaatttccgtttttttcataaacggcggtgaatattgcgataaaatgcttcggaatccgaaaagattcccgctgtttacgaaaaattctgtaaattctctatttttgaacaagccctaaatagctgattaaatttccaaagcgtggggtgacaaaatatagcagatgcggtaaaatggatttattcggagagggggaacagccagatggaagaagccggagcgatatccgtagcaacgctgcgcggcgttggagagcagcgcgcccaagcgctcgcgaggcttggaattgtgacagtagaggatttgctgctgcattatccgcgcggctatatcgacctgacagccccgtgtgaggtaatgagcgcgccattggatcaggtctgtgcggtgcgtgccacagttataaaaaagggacgtgaaacacgtctgcgcggtggattgcgtctatataaagtgatagccgcggatgactccggcgtactggaactgacctttttcaatacgaagtttacggttgacgccttaaaaatagatgagccatatttgttttatgggaggatggagggaacgcttctgcgccgtgagatgcgcgcgcctgccgtttatccggagcgggctgatcagccgtttatcgcagtctatccattgactgaaggattgacgcaaaaagcatttgccaaccttgtcgagcaggcgcttgcgcgcgctcccggactgccggaacggattccagagacagtacgcgcaggcaacggtctggaagggattggacaagcagtgcgcgatattcatcgtccaagcgacgcggcagccctggagagagccaagcggcgattgatttttgaagaattatttatgctcgcggctggcgtgggattgctgcgcacacgtgcgcgcacggaacaggccgcgccgatgcagccgcattcgctgaaggcgttttatacggcgttgccttttgaactgacaggggcgcagcgccgtgcaatcgctgatctgacggacgatctgcaaaaaccgactccagccaaccgattggtgcagggcgacgtcggctcgggcaagacaatggtcgcggcggcaggcgcgtactttgcatttctgtcgggcgcacagtcagctatgatggcacccactgaactgttggcacgtcagcattatgagggcctgaaaccgctttgtgaaaagctgggaatgaaaacagcccttttgatcggatcattgacgccggcgcagaagcgtgctgtatacaatgcgctggaaactggagaaatcgacttgtgctttggcacgcacgcactgatttctcagggagtccattttatgaaccttggccttgtaatcacagacgagcagcaccgctttggagtggcgcagcgtgccaagctgcgccgcaagggacgctgcgcgcatacgcttgtgatgtctgcgacgccgatcccgcgcacgctggccctgatgatttacggggagctggatatttcagtaatcgacgaacttccgccgggacgcagcccggttctgacatataagatcagctctggcaaacgggaacgggcgtttggatttattcgaaagcatcttgaccgtggcttacaggcttatattgtatgcccgcgcgttgaagccggggaggaggatatgggcctgcacgcggccacggaatatatgatggatttgtcgagcggtgcgtttaccggatatacagtcggcctgctgcatggacggatgaaggcgtctgaaaaggaacgtgttatggagtcgttccagcgcggtgaaatccagcttcttgtctcaacaacagtcgtggaggtgggcgttgatgtgccgaacgcggtcattatgatgatcgaaaacgcggagcgtttcggattaagccagctccaccaactgcgcggccgtgtagggcgtggaaaggagcagtcttattgtatcctgctgtctgacagccgcagcgaggagacggtcgagcggctgaaaataatgtgcaaaacctcggacggctttgcgatcgctgaatacgatttgaaaacacgcgggccgggcaattttctggggcaggagcagcatggcctgccgcgcctgcgcatcgcggaccttgtcacagacgcggacaccgttacgcaggcgcgggagtccgctgagtatatactcgccgctgatccgacgctttgcgcgccggaacatgccgcgctgcgcgcggctgtcgagcgcatgatggattcagtcggcggacgcccaaattgatcagaaaagggccgtcacacaaaagcgcgcttttgtgtgacggcccttttttcaggcttcgccatggtttcattgcacggcaggcaaaactttttttttacactgcgccagaccttctgtttgcggcgcagccaattaaagtttttcgccgaagccttttttcaaaaaggctggaaagtttttcgccgaagccttttttcaaaaaggctggaaagtttttcgccgaagccttttttttaaaaaggctggaaggcaggaatgtctcaggcgtgcttggagcggtaaatatcgtaagcgtcgcgcgcgatcataagctcctcgttggtcggaatgacccagattttcacacggctgtccggagcggacaggtcggtttcagcgccggtgcagacagcgtttttcgcctcgtcaagcttgatgccaaagaaatccatgttcttgcagacgcccgcgcgcacgtcggcggaatgctcgccgatgccgccggtaaatatcagcgcgtcgataccgttcattgcagccgtataggagccgatgaatttctgaatctgatagttgcgcatctccagagcaagcgcggcgcgttcattgccgctgttcgcggcctcctggatgtcgcggtcgtcactcgatacgccggagacgccaagcataccggattttttgttgatgatgttatgtacttcgtcaagcgtcaaattctccttgcgagcgattggctggagaagcgacggatcgatgtcaccggtgcgcgtacccatcatcaggccggccagcgccgtgtaccccatcgacgtatcaaccgatttgccgccgtcgatcgcacagatcgacgagccgttgccgagatggcaggtgacaattttcagctcctccggctttttgccaagcagcttggccaggcgcagcgaaacatagcgatggctggtgccgtgataaccaaagcggcgcatcccatacttttcgtagtattcataggggatggcgtacatataagcttttttcggcatggtcaaatggaaggagttgtcgtaaacagcgacctgcaccttgccggcgaaggtctgctcgcacgcatgcacgcctgtcaccatcgccggcagatgcagcggaaacatgtcgcgcgtcgattcaatgtccttcataacctcaggtgtgatctcgttggacatggacagactcagagccagacgatgtccaacggcaacgatgtcgtccatgctttcgataaccttagtttcaccgttcataagcagctcaaccacgtgatcgagcgcatccttatgtgtgggcagatcgatattgatcacctttttttggccgtccccatatttgtaggtgatgataccgccggcaataccgatgcgctcgcagttgcccgatgcgaccacgctttcattttccatattgatgagctggtatttgagggtcgagctgcctgcattgactacgaatacattatccatcccatatggctccttttctttcagatattttacaaaatgttttctataaagaaaaaattaccaactgtatgtatccggcgtactaaacgcgccggatgatgcccattggtgtctgttcgctgcactggccgagcgggttgtccttgaggattttgcagagcagttcgcggtccatccgtttgtcggaggtgcccaggatctgcccctccagatcgttgatatcggtgacggcgacctgcgtaccgcccaaccgctgagaaatatcggacgcaacaccgtcgggacggtcggggccgagcacaacatagtggttatagggcggcagtgtgaattcacacggaccgtcaatgctgcgcgcgcgatatccggcgatgttgtaaaaccagccccggatgccgaacagctttccgacagccgagacggcggcggcaaacagaatacggatggtgccgcattcacgcagagcgcattccattgtttccggcatggccagcccgataccgtatggcgtgcgcagaacaaatttgcttaaaaaccgcgcgagcgggcgcggatggatatcctccaggggaatggcgcggcgctgcgtacaggcgaccgccttctctgtgatgaatacaatgtcaccatcctgcacaagcggagcagcgtatttttccacaacatcaacaatattatccttgtcggtgatgacgtgcgttttgatgcacaggcggcggtactggacgccgtcaacctcgatggtttcattcttttccggattgacgacatacccttcggagctttcagactgctgcgcagcatccagtgcggcgttttcctgtgcgtccggctttgcggcagctgtatcggctgtgggcgccgccggtgtttcgtttacggcttgtacgtcgtttgtttcgttcggcatgttttacaatccctacctttataaacttcgtcgatgagacatgttgatcaaaatggattcaggccgttttttgagcggtcttttctattgtgcaatctcactccaaaattatacaactttttacctctgccgtcaaagggaaatacgcgccgcgcggcctgttcaggcggctgcttcggacgcgcctgcacggtcgcgccggatgcaccaggctgtgatggtcacgatgacgaccgcgccgccgatgagcgcgaacagaccgggacgctcccctgtaaagagaaagacccatacagggtttaaaagcggctcgagcgcgccgatcagcgagcagacgagcggcgggcagttcttgacagcgatgccgtagagcacataggggataccaagctgaacgacgccgagcgcaaaaatgctcagaactgctgacgcagatataggcgtatcaaagagaagcatacagggcacgccggcagccgccgtgaacaaatggccgatcaggatcccgctcatacggctttcctcgtcggcgcggcccgtggcgatatacatgaccgccatggaaagacccgcgccgatggcgacgaagttgccaagcaggttgccgggcgagagctggtcaaggaaaaacagcgcaataccacacatggtaagcagcacagcggcaacatcggcgcgggcgaaccgctggcgaaacacgagcgccgacaaaatgaggataaataccggcgcggtgaattgaagcacaatcgcattggcggcggtggtcagcttgttggcggagacgaacgccaagaaggtcagcgcgagaaaaacgccacacacaagcgacgtacggttcacacgcacgcgcagccgggccgcgcgcatatacacaacgacacaccccgctgaaatcaagctgcgccatccggcgatgaccagcgcgttccaggggatcagcttgataaaaataccggcgatgctccatagcgtggagcagatgaccatcaaaaggatagctcgtttttgggcggcttgctgcaaggatactcactccgtctttggcaatcttttggcatggcggcgctatgccgggatagcatttcatatagtaacgcaaaaaagcaaaaattacaagtccggcggggaaaataggctttattatgcggaaaaaaagtgtataataaaacatatgtgatcaagggcttggctgaaggggagggcaggcatgcctttccatttgaaacgagcttcatggccgggtgcggacggccaagcttagaacctgtattgacagcccgcctgcaaaaatttgccttgatcgggtataaaatccctcgcctgtctaggatactttggatgtgaatacaggttcttatttgaaaattggaaatggccaatcatagaaagaaacggcgttttctattttcaagcagccgctaaaattgtattttgaggagcgcctgatggtattcgccaatttgctgtttatttacctgtttttgccactcaacctgatcctttactttctctcaaagcggattgtctaccgcaatcttgtattggtggccttttcctttgtcttttacgcctggggagagccggtttggtttatgctgctgctgacatcggcggcgtttgactatatgcacggacggctgatcggccgtttccgcgggacatggatggccaaggcggctgtagcgtcgtcgctggcgctgaatctgtcgctgctcggcagttttaaatacagcggattcattgtgcagactgtcaatgacctgttgggcacgtcctttggcgtgccagccttcgcgctgccaatcggcatctccttttatacttttcagacgatttcctatgtggttgacgtttaccgcggcgataccgaagcgcagtcaaatccggtttactatctgttatatttatcgatgtatcaccagcttgtagcaggtccggttgtgcgttacgccgatgttgcgcgcgaaatccgcagccgcaccgtggatgcagccagcttttcggagggattgacgcgttttgtgttcgggcttgcaaagaaagtgctcgttgccaacgcggccggcagcctcgccgacacctatatggcgactgcgccggcgaacctttctgtcggggccgcgtggtttggagcggcgctctttacattgcagatttattatgatttttcaggctattccgatatggccatcggccttggccgcatgttcggctttcactataaggaaaacttcaactatccatatatcgcgcgttccgcgaccgaattctggcggcgctggcacatctctctgtcaagcttctttcgcgactatgtctacatcccgctcggcggaaaccgaaaccatccctaccgcaatctgtttgttgtatggtttctaaccgggctgtggcacggcgcttcctggaattttattctttgggggctgttttatggggtgttcatcatgctggagcgcgcttttcttggggaatggctgaggcgtattccggcagcgtttggccatgcgtacctgctgcttctgacgcttatcggctgggtcatcttttattttaccgatctcggtcagctcggcggatatctgcgggccatgtttgggctggccgggaaccgcttgtgggacagcggcgtgcagatcacactgcttaataacatcttttggttcctgctggccgcggtgttctgtattcccattgtcaggtggctgcgccggtttgtctgcgaccgcctgtctccagcgaaggccgccgtgctgtttggacttcaaccacttttgaatctgaccctgctgctggtcagtacagcgcagttggtcggccaaagctacaatcctttcttgtactaccgtttctgatcgatcgccctggaggagcctgaaatgaaatacaatccgtataaattatcaaagcatggccggtatcaataccgatacagccctgtaaacaagccggagacgctgcgtactcccgatcccggagaggagcgggcggattattatgaacgcctgcggcgaaaattcacaccggagcagcttcggcgtctcggctggaccaatatcgctgtgatcggctgcgcgctggccttattttttctcgcctcgctgtttgtggaaaagcccgttcgttctgtgattgaaaagcgtgacctcgcgcgtttcccggctgtttcgtccaaggcgcttttttcgggttccttgacgcgcgatgtggaaacctggtatgccgacacgttccctctgcgcgatgcgtttgtcggtttgtcggctgttgtggacgaagcgcacggcgtgcgctttgacgacgtgcgcatcgttgccccgtccggcggtgagacgcaggatatcccgcccgacgcttcgaccaacaccccggttcagccggcgcagccgcgcgccggacaacagaacgcggccgtttccagcgaggacgcttcgtccggtcaggatgagcaggcggagccgtttgtgccgcaggtcgacccggatcacgatcatgcggtgatcgacgacggcatgggaccgggtgcgatcaacaacggcacgtttgtgtataaagggatggctatgtcgctgttcgggggcctgcgtgaaaacggcgcatggtacgccgagacaatcaaccgctatcaagatgagctgcctggcgtgcgcatttacgatatggtgatcccgacggcaatcgaattttatgtgccggacaaataccgcgatttgacgcagtcgcaaaaggagatgatcgattatatctatagccggctcgatccaaagatcaagcgggtggatgcatattcacagcttcaaaagcattctgatgagtatatttatttccgtacggaccatcattggacagggcttggcgcgtattatgcatatgtcgctttctgtgagcaggccggcatcatgccgctgcaaatcagcgactttgagacgcggcgtctcgatgatttcataggaaccatgtacgcgcagacacaggatacgaccttgctcaagcatccggactacgtcgattactatattttcgaccagccctatacagccgagcggtatgaccgcggcgcaccgtatacgccggttgactggacgctttggggcgaatatgcaaaaagcccgaacagctattccgtgttcctgcacggcgattttccgcttgtcaaggtgaaaacaggcatcggcaacggccgcaggattatggtcgtcaaggaatcatttggcaatgcgttcgcaccgtttctgatcaatcattatgacgaagtgtatattgtcgatcagcgttattttgagcttggcgcaattgattttatcaagcaaaacggcatcaatgagctgatctttgcaaacaattcgttcgcggcctgcacgccgtatcatattcagtgtatcgataacatgcgccatcaagctatttatgacgcgccgcctgcacagacgccgtctgaggaagtcctgccggagacgccgtccgggtccatgccggaagtgcaggagcctcagacgccggagtactcctctgtgccggaggaaccggagcaatcctctgccccgcagacgcccccggctgtgccggaggcgccatacatacctccgcagacatatgtgccgccgcaggagccgtctgcatccgaaccggaggcggattcgcaggaggacgagctgtatgagcaaatggatgatatcgagcggtcgcgccgcctgcgcgcccgaaacgaaaaataaggggaatacgatgaaacgtctgcaacgcgtgctgaccggcatgctatgcgcggcgcagctttgcggctgcgcttccgcgcccgtacagccgtcgggtcctggacagacaacacagacgctgcgcttcatagtcagcgaagacctgggcgcggatatgctcgccgcggccgacgccttcgccgaccgtgtggcgcgtgtaagcggcggcggcctgacgatcgatgtgcgcacgggccgcgccgaattcggcgcgctgtcgcgcggcgacgcagagctgatgctgctgcgcaatacgcagttggcgcgcgcaaattcaatgttttccatgttcacgcttccgtttttgtatgatgacaaccggcatatgagccttgcactgaatgcgcaggatgtgcgcgcgcaagtaaacgaggcgctcgccgggcagggtgtcagcgttctgacagcgatttatacaggcggcctcttttttgtcagcgatgcaagcgagctgcgcactcccgacgatttccgtgatctgccgatcgctatgcgtacagacagttctgacaagctgacgctgcttggcgcactcggcgcacgggttgtaccgtattccaaagatgcgatcccggcggcttttgacacgcaggcccagtatctgccgtctgacggacagacgccgcagacggttgcgatcggcacagcggaggtcgatgcttcacagcttaaacagatcgacgccgatcccaatacgctttatttaattaaatcgtaccatacctgtacgccggtttggctggcggcgaacacggccgctgtggagagccttgggagctatgaacaggccgttttatccgaggcgtgcgccgggctgctcgcggagctggaagaacggttcatcacaacagagcaagcggcgatcgatgcgtcggagcgggaaggaatgctgcttgttgaaccggaacgcgcacagattgccgctgcgctttacgatggaacagcagagcgcgcggtggtgctgccgtcatattttgaccggcggttgtatgatttgatcgaatcatatgccacgctttcctgaggtgatggttaaagcggactttcaaacgcccgcgcaaatggcggagcggctggccaattttttatagattgcaccgaaatcaaaaaagggatccgtcactgcggatcccttttttcttattcatcgcggataatcagcccgcttggggaacggtgaatgcggccgttgccactgtttgcgtcgtaatccggatcactgccgtcaaaatcctcgtcgtcgcggcccggcctgcccccgaggtcctcggcaattgccgcgtcgcaggtggtgcatacaggcggcatgttcgatgtcttataccagccgacggcggtggttggacagctttcaccggctaaatcgccggaagtggtacaatacgtcgcttgctgcacatcgccccaaaccggccattgctttggttcaagaccttcgtgaagcggtcccatcaaagatttgtatagcaccggcggcgggtagggaacgccggtataccggatgcgctccggctcgtcgtaacccatccagatagctgtgacatagtatggtgtgatccccataaaccactggtccttgtcgtcgtcggtcgtacccgttttgccggcgaccggatagcttgcctggttaaacggggctgcgccgccggttccgtaaggaccggtcgtaacacgctgcatcaggcggttgacgatggtggccgtttcgggcgaaatcacacggcgcggcgtggtatcgcgtgtgagcagcacatcgccgtcggcgtcgagcacctgcgtataagcgtacggctcggtataatagccgccgtttgcatagatctgataagcgcccgccatctcaagcggggtgacgccggttgtcaggccgccgagcgccatcgggaatacgtcaatatccgaggcgacgccccacgacgtcacaagacggtctacaagcgaagtcatgccgagtttgtcgtgcatgaaatcaaaggcgacttttggtgtaatctgctggatgatcttgaccggaactgtgttggtcgaccgctggattgcctcgtcaattgtgatcgggccgagataggacatatagtggttgacgagaatatgcccgccgcccagatcgatcgggctgtcgtcgattttggacgaccaagtgtacatatctgtttcaatcgcctggaggtaagcggaaatcggcttgatcgccgaaccgcactggcggtatgcgtcggtcgcgcggctgtattcacgcatccctttcttttcgccgatcccgccggccagcgccagaattttaccgtttggatcaaggattacagcggctgactgcggatattcgccctggtttgtgacggtcgggaaattcttgacgtcgctgtaaaaatcctcgacataattttgcatatccgtatcgactgttgtatagatccttagtccgccgctcgtaaccatctgctgcgcgacctggtaatcataaccgtactggtccatcaaatccgcaatgacctgttcgatcacgtaatcggtaaagtagctgtaaacgggattgacacggtcgattgccgcctgcggcgtgaacacaagctcctcggcaacggcgtcgtcatattcctgctgtgtcagatacccttgctcgaacatcgcatacaggatgtcctcctgacgctttttgttgttttcagggttggtaaacgggttatatgcgccgggggcgttcgtgatgccgatgatcgaagccgattccgctacggacaattcggaaacgtccttgccgaaatagacattggcggcagcctgaacgccataacagccgttgttgaagtaaattgtgttgaggtaagcctccaaaatctgttcgcgggaatagcgtttggagaggttgagcgcacggaaaatctcacgcaccttgcgctgcacgttgacagcgtcgtcgtcggtgatatttttgatcaactgctgcgtgatcgtcgagccgcccgcctgggttgggtatatgggaataaacatattgacgaacgcgccgaacgtgcgcttccaatcaacgccgttatgctcccagaaacgcttgtcctcgatcgcaaccgccgcgtcaatcatatggcggggaatttgatcgtaatcgacccatatacggttctcgatggtctggagccgctgaagctccacataatcgcctgtttctggatcggtttcctcggtataaaggatggtagtgtaacgcatgtcgatgttgtcaaggctgacctgatcgtccgagttgacataacgcaggatatacaccgtcagcacgcaagcgatgatacagcctgtgatgatgcccaccatgatcagagcggcaatcacacggccgatattggcaaaggtaccgccaatgatccggccgacggaatgctctttgcgtgaactcaaattagaagccccctttgtctatctaaacaccatgctggcctttttttagaattacataacttatagtataccacatttgccatgcaaagtgttactgatttttaaacgaaaatcagtacacaaattcgcatgtgattgacacgtatatgtatattttaccttaatagtgccaaaaatattgtaaacgaatccacggcgaaaaaatttttttgccgcggcggcgcgaagccggccgcagcggccgcgccgattctgaccggagggactcttatgcgcaatgcaattttgctcaccctgattggggtgatcgccgtatcactgattaccatcggcgtggtttacgccctgccgccgcagacaccgtccgtattgacgccgtcgggcgcgtccgaacagattgtctcagaggatacgtcgaactatccgtacctgctgcgcacctatgagggcaagctggcggtttttacagacgaccttgtgcagccggacttggtatttgatgtgtatgtgcgcacactgccggaacttgaccagcagcagctttcccgcggaatccgtgtgaaaacgtacgatgaattgacctccatgatcgaggattatatcagttagttgcgtgttaccgctttgtaacgattacaggggtgtttgtaaccggattgtaaccggattgtaatcgaaaagggaggaaatcgtaccgccggtgttctataatataaccatggtcggctttggggaaagccctcctgaaaaatcagttttaaagcgggtctgatcaacccgggtgtgcgctctctttctctcaggaggctgtcgtttgacagtctctttttttgtttacgggcggccgccccggagatattgctgatagataatataaagcccatcgagcgtcagcgtgcggtccacacatttaaaaacgccggtttcctccgccagcaggcttgcaaggccacccgtggcgatcacctgggcgcttccgcccagctcctgcttcatggtatttacaatgttgagtactgcgcccgcatatccaaaaaaggcgccagcctgtaagctggaaaccgtattgcgcccgatgacgctgtccttgcgcacaagctcgacgcggggcagcttggctgttttatcaaacagcgcgcccatcgagatccggatgccggggaagatcgcgccgcccagataagccccgcttggatcgacggcgtcaaacgtagtggctgtgccgaaatcgacaataatgagaggcccgccgtatttatgatacccgccgattgcggcaaccaatcggtccgcaccgacttccttgggttggtcatagcggttttcaattgccagcggcaggttgtcgcccactacaagcgggattttgttataaaaatactttttcaccgcgttcacaatggaatgcatgacctgcggtacaaccgaggtgattacgatgtcctttaccgcgcggcggtcaaaatcgttctcgcggaaaaattgcgccgtgaacagaccgatttcatcggaagtgacattgtggttagtcccaagccgaaacgatccgatgatatccggacctttaaacagaccaaattcaatgttggtgttaccgatatcgattgtaagcagcattatgtgacctcccgtaagcttgatagctgcaatcagtataaaacccgcccggctgttcgtcaacaaaaaacggaaaatctttgaaaaaatttttggaattcatatgaaacctattgacggacaagttgtttaatgatatactatttaagcgtcattaagttcaaacgctagtatggctcagttggtagagcagcgcattcgtaatgcgcaggtcgtcggttcgagtccgactactagctccagactgcctctcttgtccgtatggatgagaggggcattttgcgtcgtttaaaagctgtaccaatgggaaacgcacatgccttgacgcaaaatttcctgttcggagcgcgtcagaaaagcttgaaatccgtcaggattcccgcgcttcccccaattggcgcagcttcttaaaattccatataatgaatggataaacttgtgtgcggatataaatcggaatgaggaggatgtttggtgatcttatatttttccgggacaggaaacagcgaatacgttgcaaaaagaatcggaaaagaaatcaatgatgaagcggtaaacctgtttgaaaaaatccgaggcagggacttctcagagatgaatacagaccgtccttgggtgatggtcgtccctacctatgcatggagaatcccccgcattgtgcaggagtggctggaaaacacacgtcttactggcagcagggatatttattttgtcatgacctgcggcgaaaatattgggaacgcgggcggatacctgcaaaaactgtgcaatgaaaaaaagatgaattatatgggctgcgtttcaataacaatgcccgaaaattatattgcactgttttcaacgccgacacgggaacaggcgatgcagatgattcagcaggcggaaccagacatagacagggctgcgcttgcaattcaacgcggcgagatgtttttgcagcacgcggctgccgccaaggacaggatactcagcggtttggtcaactcccttttttatccggcttttgtacatgccaggaggttttatgcgaccgaagcctgcatatcctgtgggaagtgcgtgcgggtctgtccgctcggcaatatccgtctggaagaaggaaaacccgtatgggcgaacaggtgcacacattgtatggcctgtatctgccgctgcccgtgcgcggcaatcgaatacggcaagcgcaccaggaaaatggagcggtatacctgccccaaaagtatttgattgcacacagataaaatacaggcatgtattgccatccatcacaacaaaacaacagccgcccatgccaataggacatgggcggcttgcatttacgaaacaatcagcggcttgcatttacgaaacaatcaaccgagcgccgcggaggcggcgtcattgtccgcacatgcgatataaatcagcagatcgccgcgcagagttaaaaggtgtcccttgacacgcgcgcactgctcaggctcataaagctccaattgcgaggcaagctttccgatcgcgtcggcgatgttgtttttgacatcgttttcacggccgtcggcaggatgcagaatgaaataaaaacaactatcctttgcaaagcagatccgccagtcgtcaagcagcgtacaatcgatgccgtatcggtttagaagctcgtcctcgtcgggatgctgcgggtccgcgaacagcggatcgcctgcgtcatccgtcagggcttcgagcgtttgtgcaagcgaagccagctgcgcaggcgctgcggcaggctgcgctttgccggaacaggctgtagaaaagaggcacagaatcaaacagaataaaacggccaaagtacggccaaagcggttcataggttggtcctccaaacggtgaattttatgtctcatcgccataatagggatgtgtcagaatatagttgcggatgatctgatacgtttcctcgcgcggatggataccgtcggagctatacagggaatcgggaagcgcgcgtccatctgcgcccttgagggcttcggcgacattgaggaacttcacattctttttgcggcagacctcggcgagtgcaaaattgatccggttgcacttatcgttgttggtggtgtaggcggcgtttggagaatcgtcataacgtccatcgaccggatagatcgatgagacaacaatcaacgtattggggctggccgcacgcagcgcatcgatgaaggcttcataatgctgcgcgtattcctccggcttcatccaaaaggcgcagttggagccaacattgacgacaacacgctcaggttgaaaccgtgccgctgcttcgcaggctgtcagctccagatcgcgcccctttggcgagcggccataaattgtaatcggcgtatccaaaatagtgtcgggctggagcgccggcttggaccagacgctttgatagggatagcagccgaacgcaagcccgttttccgtgatgctgtcgccgataaaaaccgtatcctccagatagctttcatcggccggagctgtctctggcaggataacatctgaaaaatagccgttgagtgtgaaatccgcaatccccattgttaatggagaggaattgtccacacgtacacgacgtgtagctctggcgatattgccgcttgaatcagcggcctcatatacaagctcgtaatcccccacggcgcttgtgtcgaccgttccatggactgttacgcgcccggttatatcgccgtcccagttgtcaacggcatcatatcccgggtcctcaaagacgctgttcagagcgaccgtcagttcggggctgcccttcaggcgcaattccggaatggtgatatcgcggacctgaacattgcgggcaaggggtgtgctccagggaatgccgtccagtcggtaccaaattgtataattgcccggggtgctgtcatctacagcgccgtctgaagaaatccgatcggatagatccaatccgaatatagacgcctgcgcgccttgttcccggtaacggtcgccaagtgcaacgacggtttcggcgctgccattgagcgaaaaatgcgttgtcagcagggcagccgctccggcggcgagcaacacaaaagcgccggaccctgcaagcagccatttcgggcgctttttagcgggtttggctgcctggtaatcaagctttgtttccatattttttatgtcctttatcaaaacagataaaccgttgatgcttgcgtaaaaaaatggtggatgcttcctttaaaatatcatatcattttccgtcggtttgtaaagaagtttttgtttttttgcagaaaatagttgtcgtacatgtgttttttgcacagccggttctctctgcctggcgggctaaacgacaaaaagaactggaatctctcatgaaacggtggtataataaccgcaaaacggttattataccatgtccgcgaagcggcatggtataatcggccatcggggcggaagcgggccgcgcccgcgtatcgccccggccataagattggtataataaccgcaaaacggttattataccatgtccgcgaagcggcatggtataatcggtcatcggggcggaagcgggccgcgcccgcgtatcaccccggccataagattggtataataaccgcaaaacggttattataccatgtccgcgaagcggcatggtataatcggccatcggggcggaagcgggccgcgcccgcgtatcgccccggccattggagcacgggacatgccccaagacatgagaggatgagacagtgaaaaatctgaagcagtattttgtggcagcggtcgttgtctgcgcgctgctgttggcaatgccgtccacagcgttcgccacggacgggcaacgtatgcctgacagttattttgacgacgcagtgttcgtgggcgattccatttcactcaagctgcgcaactatgtctataagcagcgcgccggcgatccgggttttttgggaagcgcgcagtttttgacagtgggggggctgggaagcggcaacgttcaattgccaattacagcggattccctgcatccggtttataacggtgaaaagatgatgctggaggattccgtcgcagcttcgggcgcaaaaaaagtttatatcatgtttggtatgaacgatattgtgccctacggaattgacggcgcaatagaaaacttggatgtgctgattggaaaaattctggagaagtcgccggatgtacagatcgcagttcagtcagtcacgccgattttgcaaaacaggcagcaaaaaaatctgaacaatccgaatattttgttgtataacgaacaactagaggcgctgtgtgatgcacgtgggtacgattttcttgatataggcgctttgatgcgcgatgaaaatggcgcgttgatttatgagtattgcgcagatgcgccggggcttgggatgcatctttcagatgcggcgtgcgtgccgtggatcgagtatctgcgcacacatccgctcggcagcggcgccgatctgcttacacctgcgtccgaggaggacgcaggtcaagcggtggacccgcttttgagccggcctgatgattttgccgaagaacaggtggacgagcctgccggcgagagctttgaaagcggcctgaagcagccgcctcaaaaacgggatcccaaccgcagactgaacgcgcggtagggacttttgttgtatcttgaaagaattggacgcgccaattctgtaaaagcgccggcgtattcacgccggcgctttttggcacagcgcggcctttaggcggagaaggcgctgttgattccgcattcaccaatcggataaaaatttgttgatatttatatcaaatatgatataatttaaaaaataatatgtatacgcgttatgaatactgaatttgaaattttaacaataaaaacgcgtatatataaaaacgagggcgcgctgacgcggacgcaggcaatatgggagagtcgtttttacattacgtgaagcagcccggaaaatgaggagaattgagatgaaaaaactggcggtattgctgctggcggcttgtgtggcgctgggcggcgcgggatgcaaaaacagtgtttcggatacggtttcaggcttggtagaagatgcgggtacagccattcaggccgacggccgcgagtatgggcagacctacacctttgaatcgggagaactggtggaaacggcgttttttaatttccaggtaaacgaggtttcaaccgcggccgagatagaaggctatgtgcccgaggatgaaacgaatcaatttttggttgtcaacgttacaattaaaaatacctttgaggatgatgcaagtatcccgatgttcgctaccgattttcagcttatttgggcggacttgggcgacacgggaatttatcctgatacgcaattcgctgagggccagctccccgaggagtatcagcttttaaaggacgaaagccgtaccggaaatttaatttttatcgtaccgagcgatatcactgaatttaagctccaatatctggaggtctggagcgatgattttgaggggaatacatatttcgtaaatctaaagctatgaagccagacgcacaaaacggccgtccatacagttgggcggccgtttccttgttcgtgctggcatggccggagggccatgccacagagtagaggaaaggaaaagaggagagatatgaaaaagaatatataaatcccttgcgggaagaactgtttgatttgccggaatcgggccggtgttccgtccacccgcgccggctttgctgtttggtatgctcatagtatacagagcaattgtggatggggttttagaataatcgaaacaatgtgaaaagaatttgtgaatcaaatttgaacctggtttaggacgccggatttcaacatacaggtgtgcgcagaaaggcgaggagctgttgattgaagctgcacagctcgtcgtaaaatacagcgtggccgctgttttcaaatgcaaaaagttgtgcacagtctgtggaagcctgcgaaatacaggcgtcggcagctttccgcgtcacaccgcaaggaaagtcgctgcattgcgtgaaacttggagaggccgcgcccggagcacaagctatttggcttcgtagctattgtaagacgtgcgatgctcaataaagtcctgctgcggtcatgcgtccgtttcttctatccagcggtcgagccggcgcgattcgtggacagcaaaacaaaagacaaggattccggcagtgatatcggcgaccggaccggcgtacaggatgccgtcaagccccatgaacagcggcaggaccaaaatcaacgggatcagcaggatcaattgacgcagcatcgacagtgcagacgccttgagcggctgaccggtcgcctgaaaatagctggtcgtaacaatttggaaaccggagcagaaaacgccgaacataaagatacgcatacatttgaccgcgaaatcagtaaagagctgtccgccagagccaaacaggcgcagcagaagctgcggcgcgaggatacagacaagccatcccgctgttgagacgatggtggccattgtaacggcgatgcgataggtctgcttaatgcgccgcggctggttggcgccccggttaaagcccaggatcggctgtgaaccgattccaatgccgatgtcgacagcaatgaggatggcgctgaccttgacaacgatgcccattgcgctcaatgcaatatcgccgccgaccggcgactgattgccgtaatagacgagcgagttgttcattgcaatttgcagaatggtggaggcgagctgcgtgatgcagcttgaaacgcccagtgcgatcactgttttgcagatatggccggctgggcgcaggtttgcccggcgcagccgcatcttgccgcgggacaggaaatataccgtcagtacgacggccgaaagaatttgcgaggtgatggtcgcaatagccgcgcccttaacgccccagccaaaaatgaatatgtagatgggatcgagaaccgtgttgagcgcgcatccgatcaccatgctgtacatggacaggcgcggatttccatctgtgcgggccatgtttgaaagcccgacactgagcatattaaacggcgcgccgattaggatgatggaggcgtaatcgcgcgaatactccaagttttgcgacgtcgcgccgaacagatgcaggatcgggtccaggaatatcagcccgaccgccgccaacaggacgccagcggcaagaaggagcataaagacgttgccaagcgtcctctcggcctcctcctcgcgtttttcgccgagcttgatcgcggcataggcgcttccgcctgccccaagcagggtgctgatggacaacatgattgtcacgatcggaaacgatacggttgtcgccgcattgcccagaaaaccgactccctggccgataaaaatctgatcgacgatgttgtaaaccgcgctgaccagcatggaaatgactgccggcagcgcaaactgtgccagcagcttctgcaccggctcatatccgagtgggttttgttgtttttcgatggcttgtcccattgcgtttttattcctcttttcccgtttgatcagcctgcttgtgtgcagcacgtccgtgcggcgcgctgtcattggaaacatattgatgcgcgttctgtgacatcgccaccaaaagcgttttggcagcttcacgctgctttgatgtcataccctgggtcagaatatcattccagcgctgccgcgccgcgagcgtagcctcgatcacagggcgggccttctccgttacgtaaaggcgcacgacgcgccggtcatttggatcgcccacgcgccgaatgtatccaagctcctccaatttttggacggcacgcgtcgcggtaccgcggtcaaaacttccgatctgcgccagttccagcaggctgatgccgggaagctgcgagatgcgaagcaaaaaaaactgctgtccgcagccgatgccatattcacgcagaacgtcgtcgtagtacgactgtccgcagcggtaaaggatagagatgtgcttgctgaaggaaaattggccttgttccatttccataatcatacctcgctttttgtaaggcggctgctctataacatgagatataaacagcataacacatattggttgcacatgcaatcatttaagggaaatttatcagattttctgcatcgaaattgacaggcggcatatttctgtttatgatgattctgttgacaaacaaagccgtgctgaaaatgagaacaatttttctagcggaaaaaacaaaaacgcgggcatgcttttgaaaactcacaagtatttttgcgaaagctgccggaataaagcgccgctattttggatgcggcggctttgccagcgggtccaaaatgtaaacaggaaggagggagtgctttgaaggaatttaagagacagtacccattgttttcactctgcgggttgaactgcggattatgccccatgcatttaaacggctactgcccgggctgcggcgggggaaagggcaatcagccctgcgcaattgcacggtgcagtctggaccgcggcggaatcgagttttgctgcgactgcatagaatatccctgcgctcgatatcaggcaatgacggaatacgactcctttatttcgcaccgtcatatggcgcacgaccttgcgtggctccagcagatcggacttgacgcataccgcgccgaattggaggaaaaaattaagattctgcatacgctgcttgacggctataacgacggacggcgaaaaaccttttattgtacagccgtcgcattgctggatctggatgccattcgcgatgtgatggacgggcttgcgcagcaagaaaatgatgaaatggcggccaagcaaaaggccgcatgtgcggtgcgcttgtttgagcaagtggcaaatcagcgcaaaattgtgctcaagctgtgtaaaaagccgaagaaaacggctggcgccgccgaatgaaaaacgaaaatgccccggccatttggccggggcatatccgcaccgtatttaaacgtcattgtgcctgatcgactgctttttcgcgttgttgtgctggttttggttctcgcgggtcagcggcgtctggccattacattttctgatgcggacttctttcttatccggctggctgtccttgggcattgcgctcgcctcctactgcgtttggatgttgctggcgtcggccgcgatttcataaccgagcctgttgagccggtgttcgatccggtcgtaagtgacacccgagctgtcataatcaacgctgacaaggtggttttgcgtgttgacgctgacggacgatacgccgcgaagcgtatcaagctcctgtttaagctccttcaggtcgtgtttgccgtcaaggtttctgacaatgaaataggcgctctctcgagacatgttctcatcgtccttttgccgctgcgcgccggcgttattcggccgccgtcccccgtcgtgcgcagggtgtgtgccggcgggtcgatcttacagaccgggcggcgtgcgcacggctttttcaatccgtgcacgcgggggaaacgacgcggtgcgttttttcccccgcgattatgttgccctcgtccgcttgtacgatgcgcgccaatttttcgcagccgttgcggctgaaaacggcgtggatactgctaatttttgttaaaaaacgcggcccggtttgggccgcgtttttagcggaggctacgattgtccgtgctgtttttcaagcagcctgtccgcaagcgcggcgtccggttcaacaatggcagtctgatacggctcgtagagcacaagccccggcctgccggacggatgtttccatacgttgcgcacctgtgtatagtcgactgcgacctttcctgattcccgcgccttggaatgatacgcggcgataacggcggcctgttcaagcgtgcggtccggtacctcctgtccttgtgtcacaatcacgacatgcgagccggggatcttctgcgtatgcagccagatatcgtttttgcggctgtccttgagcgtcaggcggtcgttttgcaggttgttgcgtccgcataaaattgtaaagccgtcatccgagacgaagcgcagcggcgcgagacgctcctctttcatgccgcgccgcgccgcgcgccgcacataaccctgtgctgcaagctcctcgcggatggcgttcagctccgattcgagcgaggcgcgcgccagctcgtcaaatacggtgtcgaggtaaaccagctcggactcgccctgttcgatgagcgcgcgcagcttcttttcggctgtgtcggccttgcggtaacgcgcgtaataccgctgcgcgttctggctcggcgtgagcatcggatcgagcgggatttttattttggggctgccgtcctcatagtaattttcaacctccgcgattggctggcccttctcaaggctgtaaaggttcgcgttgatcaaatcgccgtaaattttaagcgtttcgcgctccgtcgattcaagcagttccttgcgctgcgccgccagcttgcgcgcggtgcgttcgctcagattcgcaagcaggcgcagaaggtccgcgccgcgctggcgcatccggtcgatgcggtcgcgctcgctgtaaaagctgtcgagcagcgcgctgtaggtgtcaaaatcacggctgacaagcgtatgcccatactggttgatatcgatataggtaaaatccgacggcttgccggcggcgtcaacgagcatcacaggatgaacttcatcgcggttgagcctgtcggagagctgtgaaagataaaatttgagccgtgtttcccgctcgccgtcaagctgggaaacaggcgtttcccagtcgcgcgcggcattccaggcgatttcgcggcagacaagcggactcatgccctccagcgccgatatcagcgccttgtaaagcggctgttccggcgtatcatgcagccgctttacaatttccgacggcgcggccttatagatgtccaggcggctgccggcaggcacatgggtgtacgtcatgccgggcaatacaggacgcacccgcgacatttcatcgcttacgcgtttgaccgcgtcgatgatacggccttcctggttgacaaggataatgttgctgtgccgtcccataatttcgacggacagcgtcagtacgacgcggtcgccaagctcgtttgtcgtttcaaagtggaaatgcaggatgcggtcaagccccgcctgtgtgatatcgacgagctttgcgcctgtcagatgcttgcgcatcagcatacagaacatcggcggagacttggggttgtcctgcgccagctcggtgaaatgcacgcgcggattcgacgccgacgccgacaaaagcagcttgcggttgccggcgcgcgcgcgcatggcgataacgatcgtttcacgggccggctgatgaatcttgtcgacgcgcccgccgacgaccgcgccggccagttcgcgccgcagccgggtcaaaaatactccgtccagaggcatatacgttctcctaaatgtacaaggttttcgatgaaggataaaaacagggggcgttgacagccgcggaccgtttaaagcgtcttgagaaaacggtcgatccgcttaagggcttcgagcaaatggttgacggaataggaataggaaatgcgcacaaacccttcgccgctttcaccgaacgcatcgcccggaacgacggcgacgcgctccgcctccagcagacgcatacagaagtcgctgctggaaagacccgtcgagcggatgctcggaaagacatagaacgcgccctcgggcgagaagcagtcaagccccatgcgattcagtccatccacaagcagacggcggcgcatatcatactggccgcgcatctcctcaatgtcggcgtcgccgtttctgagcgcctcgactgcggcgtactggcttgtcgtgggggcgcacatgatcgaaaactgatgtatttttgtcatctgcttaatcaccggagccggacccgccgcatatccaaggcgccagcctgtcatggcgtagcttttggagaagccctgcaccaggatggtgcgttccttcatgccgtcgatttcggcaaacgagatatgacgttcgtcgccatacgtcaattcggcgtagatttcatccgacagaaccatgatgtcggttccgcgcagtactccggcgattgcctccagatgtgcgcgccgcatgactgcgccggtcggattgttggggaagggaaggatcagcagctttgtgcgcggagtaatggccgccttcaattgctccggcgtcagtctgaacgcgtcctcggcgcgcgtggcgatcggcacgggcacgccgccggtcagctcggtaatcggcgtgtagcagacgaacgacggttccacaacgagcacctcgtcgcccggctcgacgagcgcgcggatggcaatatcgattgcctcggaaccgccgaccgtgatcaaaagctcttttttgggatcatattcaagcgtgaagcggcgctttaaataaccgcaggccgcctcgcgaagctgcataagcccggaattggccgtataccaggtatgcccgcgttccaggctttcgatgccggcgcggcggatattccagggcgtcttgaaatcaggttcgccgacgccgagcgagatcacgtcgtccatctccgcggcgatatcgaaaaacctgcggatgcccgacggcttgattgcaacggcgcggcggcttaaaattttgtcgtagtccatcacagggaggttacctcccgttcgtctttgaaatcgtcaaccatcatctggccgcgctgcttgtactttttcagcacaaagtgcgtgctggttgactggactggttcgagcggcgcgagacggtgcgccacaaaaagcgcgatgtccttgaacgtctttccgctgattgtcagcgccagatcatagccgccgctcatcagatagcacgtttccacctcgcggaactgggagatggtgtaggcgatctcctcgaatcccatcgtcccctttggaattaccttgatctcgatgcgcgccgaaacaaggttgcggtcggtctgatcccagtcgatcagcgccttgtagccacggatgacgccctgtttttcataaccggcgatcgtctgcgcgacatcctgcgcatcctcgccgagcatgacggcaagctgctcgtttgtgagcttcgcgttgtcgtcgatcagccttaacagtttttccttgttttgttccttcatgcttcgcgcacccctttttcgtctgttcagataatcttaaactggagcggatggcgctccttataaaatgtgaagtatgaaaatccggcttcaagcagcatttccattccggaatcaatgccgcggccgagcgcgtcggccgaatgggcgtcggagccgagcgtgatatactcgccgccaagctcccggtaccgtttgacatagcaaagcggcggcatggtgtcgcgcagggcgccgtacagcccggaggtgttgatctcaatcgcgcgtccgttctgcgctgtaaggcgcagaatctcctcgatcttgtcgtcgtagcggcgcaggtcgacgcggattttatgcttgccggtgatgtagcgcagcggataggtcagatgcccgataacgtcgaactgattaagctgtgcggccttgatcagatatgtaaaatattcctccagcaggcggtcgatatcgccgctgctccacgcgccgaaatcgctgtaatagatatcctcaccggacagtgtgttgtgctgtgaaaccatcaccatgtcgaacgggaaacgctcaaggatggagctggtcaaagccgggtcgtaaagcacgtcggaaagctcgatgcccgccataaccgcaagctttccgttaaacacgcgccgcgctttctgcacctcgaatacggactgtgtaatacgcatttcgtactggccttcttcaaaggtgcgcagctcgcagtgatcggtgatgcagatgccggggatttccttctccacggccttttcacacataaacatgacggaatggtgcgcgtcggaggaattgtcggaatgggtgtggctgtcaaagatgttgctgaacataatgatcctcctgtatgtattcagggcttgtttgaaaatagaaaaagtacaggattacccgcataaaaagacggttgttccgatttttcaaacagccaagatcaatggggcggcttatgccgcatcccaccgggaatctgcgattcattttcatagtatagcatacggcgatataaatagtatagcatttttatgaaaaatgtgctatactattccaaccgtgatacaaggcgaacggccggcgcgggcgccggcggtacaatcaggtttgggaggtagcagagtatgcgtgctgttttgactgtcatcggcaaggaccatgttggtatcctgtccaaggtggccaacaaatgcgccgagtgcaacgcgaatatcattgaggttacgcagaccgttctgcaggatttgttctgcatgattatgatgatcgatatttccagcgtcaactgcgagctgtccgagcttgtctatcagatgaaccagctcggcgaaaaggccggcttgtccatccatgtcatgcatgaggacgtgttcaattcgatgcaccgcatctgacgaaggagtaaacttatgcttaataccagcgatgttcttgaaacaatccgcatgatccaggatcaaaacctggatatccgcacgatcacgatgggcatatcgctgcttgactgcgctgacggcagcatcgaacggtcctgcgaaaaggtctatgacaagattgcgcgctgcgccaaagacctggtaaagactggcgaggcgctggagatggagtacggcatcccaatcatcaacaagcgcatttccgttacgccaatcgccatgctggccgccgcttccggcggcgaccccgtgcagtacgcgctggcgcttgagcgcgccgcctgcgaggtgggcgtcaacttcatcgggggtttttccgcgcttgtacataaaggcttcgcagcgggtgacgaggcgctgatcaacgccattcccgaggcgctcaaagccaccgatcatgtctgcgcgtccgtcaatatcggttcgaccaagacgggcatcaacctcgacgcggtcggcctgatgggacgcatcgtgcgccgctgcgccgagatcacggccgacgacaactgctttgcggccgcgaaactcgttgtgttctgcaacgcgccggaggataaccccttcatggccggcgcgttccatggggcgggcgaacctgactgcgtcatcaatgtcggcgtgtccggcccgggcgttgtgcgcgccgctctggccgccgcgcccaaggacctcaatatcactgaggtcgccgagctgattaaaaagacggcgttcaaaatcacgcgtatgggccagctgatcggttccgaagcgagccgccggcttggcgtgccgttcggcatcgtcgacctgtcgctcgcgccgacgccggccatcggcgattccgtggcgcacatcatcgaggaaatcggcattgaaaagtgcggcggctgcggtacgacagcggcgcttgctctgctcaacgacgcggtcaaaaagggcggcgtgatggcgtcctcggctgtgggcgggctgtccggcgcgtttatccctgtttcggaggacgcgggcatgatcgacgcggcccgctgcggcgcgctttcgatcgaaaagcttgaagcgatgacggctgtctgttcggtcggacttgatatgatcgccgttccgggggacacgcctgccgaggtgatcgctgcgatcatcgccgacgaggcggcgatcggcatggtcaattccaaaacgaccgccgtgcgcatcatccccgccgtcggccgtgaggcgggccaggagcttgaattcggcggcctgttcggcagcggcccgattatgaaggtcaacactttctcgccggcccgcttcataagccgcggaggccgcatcccagcgccactccaatcgctgaaaaactgatagatatagtatagaacagcccccggcttctttggaagccgggggctgcggctgtaaagagggagaaaaacgtccgtttaccttccggtatttggaataggtttcgtgttctggttgatgttgatcgttggtcccttgttggaattgttctgattattgctgctattattgttattgttgttgttcgaaggtttctttttatcgacgttcgccttgccatcggaaatgatataggtaccaagcgtgcgtgtctggagcgtcagcacggaatcaccgtcgtcattttcaccaaaggagaagctgtttgaacggtcgatcagttctccgtcaaccacctcataaacatagatcttgtttttgctgacggtcatacgtccattgccgtcgacgtatggattatagagcgacagtgtcgcgcgcgaggtacagggcagctttggattgcccacgaaatcgtaaaggtaggcgtcgcggttgttaaaatattcagtgtagtcctcattgttccaggccgtcgaaaggcgcgggcaatagtaattgacctctgaatcggcgcggaaacggaccgatgcaatataaccgttgctgttttcccaggtgacggtgttgatctcgtttttaaccggcttgatgactacgcccttttctcctgcgtagaaggtcgcgtcgtcgtccgtgatttgctggttgccgatatagaatttaaagtttttataataggtgtctcccgatttgagatagccgggggtcgtgctgccgccgacactggacaggcggtcgatctcggcttgtttgtcgttgatcgcatcgagccgcgctttgcgggcggatttgacgctgctgacgagcggacgcacctgctcctgcgtaagggttgtgccgggaatgacggttgaatcttgttgttgaagctgcgcaagctcggccctgtagccttccaactttgcgccgtctccggccttataagcggccagggcgttctctgcgtcacgtacagcctgctgtgcggcggcgatggtattttgcaggctgttgatctcttgctgcgccgtggggatacggtttgtttcgtaatcattgaccatcgctgtgagtgcgggcgtttcagattggacggcgctgcggatcgttgcaatcgccgtgtcgcgggctgcgtcggtgcccgcatttgcatttgcaagaacagcggttgtggcgctcatcatcatgacatccgcttccccatcatctccaacgctttccattccatcgtccagagaatcgtccgagtcgacagagaagctgccgtcgaggtcgccgaaagcgtcgctgccggttccgggcggcgtaaccggtgtggctggcgtgaggttggagggcggcagcggcgcgctgtaaacgatggcgtcaagcatgttcggtgtgatcgcagagccgtcatacatcgaggtttgcgctggatgatatttctgcacggcggccttgagcgcattgaaggtcgcttctgaaggcgcggcgtcataatttgccagtgcggtactgatccctgctagcagagattgacgttctttgaagtttgccagttcggtgcgcagatcatttaccttttgctgcgcggcggcgctgtccgggatgctggcccgcttattggagagatctgtctcaagccggcggatttccgtttcaatacgggaaatctcctgattcagataatccatgcgttccttgcgcttggccgcttgctgggatgcctgttgattggcctgattgacgctcgcctgagacggcaaaccagccagaagcgaatcgagctgcgcatcggtcagtgatgtaatggatccccaggacggcgttgcgccggacacagcgtttgcaagtgcgttttcagcatcaataatcgcctgcaaaagctcattgaccctgcgctcggagcttgtggccggagaggagaagggcgttttgttattgagcgcgtctttttcccgttgaagctgtgtcaggacggcgctgccgccggtagatgtatcgctgctggtagcgggccggaaactggggaagctgccggatagtccggatgtgatcgcgaccaagtcctttttggcgcggaactgggcctccatctcaattttgtattcatcctcggtaaaattatctttcacacggaattgaatacaaacataccggttgccgccgaattttttctcaatcagctcggcgtcgtcgatgtatttgccatttgtttttttcttcattgagaaacgcagataatcagaattcgtcaggatatcataatcgcttgatggtccaatcacataataatagtagctgcctggggcatatgcatcgtattccgtgtcagcgatttcaccgtcgctgtcaacgacctggtcaatgatgctgcggtcataagcgaaggatgtcacactgattgagaaagcgcatgcacatgcaagcagcgccgcaacgattcttttcatattcataaaaagcgcctccttttcggcttgtaattgagaaaatcagtttggtgtgaccagttctttactaatataaccaaaatgatttccagttagggacattgtatttgtaacaattctgtgaaagaactgtgaatgtctgtcctttcaaaaaaggattgacgcacaggtgtgcagctccaggaccagcgcccagtgctgcggctgtcggatggattcaaacaaacaggtgcgcttataaaaataaaggcggccggcagttgatgccggccgcctttattttcgtttcattgcgtcgttcgataatcataaagcacatcgtcgccaaccttgagcgacagaggcttatagccgctgccagcgccgctgttgagcgacaggactgccatataaggctgcgtgacactctcgccgctcgcaatcctgcggtcgaatgtctgtgtaaccgtatagacggacccatcgaactgcacggaaagatccgatttgcggaaatggacgcttcctggatcgtaagcggcggaggtcaccatttcttgtgcgcaggaaacagcatattgctcatcctctgaaagagcggttgtatgtgccgctgatgatgcaaggtctgcggagtccccggtgttataagaacgcagaaaaaaaagcgcggctgccgcggcggccagaagaataaaaataaacagcagccatttgagtatgggcaaatgctttttcgctgtggcagtgtcgtcgggcgcgctttgctcaaacgccgggagcagctccggttccggttccgttggatggagcggcgtttgtccgctcaggcaacgctcgcagacatcggcggtgctgtcctcaggcagcggagcgccgcataggatacaggtgcgaaccggcgagccgtcaccgttttcaacagcagatttgaaagcagccgcagaggcgccgcagtgaaggcaatattgacttttacgcggaatacgcctgccgcaagaaggacaaaccatacaggccctcctttttgttgaaatgttgtacgaccattattatacgattgcccttcataaaatgcaaggaatatgaggcaaggtccattgaatactggataaagtgcaggaaatgtaaaaaaaggatgagaaaatgtaaaaattgtatttctttctttccgattttgttttataatataagtacagaatttattgtaaaataaaaaaaatctgcagattttgaaaaaacaattataaatataataccaatttttcaattctgtacctatgacatttggaaaaggatcgaagaatgtattatgatgtcgaaaagaggtgtttttgatgaatagcagtcagattattcaaaaaaatattcggtatctgcgtacaacgcttggaatcacacaggaacaactggcatttatttccggcctgacttcagcatgtgtcagcagattggaacgcgacagcaaatgcaatccgacagttcagacacttgaccatatcgcggaaggtctgaaaatccaaacagcacagttgtttgatgaacagcttgcgtcggaggagggcaagtgcattacagagcttcaacgctgtatgaatgagatcatgaagctggatgtggataaacagcgggatgttatccacctgcttgataattatatccaattgggccaaattttttaacatcagacgcaataaatgtaataaagcttgcagtgttgctggttctgtccattgctgcgcggtatttacatcgccctgcacgactggtataataaccgcagagcggttattataccgctctcatggccaaggcgatgcgcgggcgcggcccgcttccatcctgatggccgattacaccatgccgcttcgcggacatggtataatgatttcaacaaatggcatgccccttataagacacccgatcttcatggctgatagcttcgtatatgtaatgctgttgacttttaaaggagggtttttcgcatgcttttgtgtatatacaggtatgaaggggcgctacagcaaaacggacaaggggatgtattgatatgggcagttacactgaacgcgcgcttgctctccataaagagggttgtaattgtgcgcaggcggtactttgcgccttcagcccacggtttggccttgatgaacggacagctttccgcatttcggagggctttggcggcggaataggtggatcgcatgacaatgtctgcggggcggcggcagccatttatatgcttgcaggcttgaaaaacagcagcggagcggccgcggacggcctgacgaaaaaggatacatatgcacgggttcgttccttgtccgaagcctttgcggaggagaatggaagcaatatttgcagagagcttctggagttgaatggccaacgcaagctgacctgtgcggaccgcgtggcaagtgcatgcaggattgttgagcggcttttgttggacgagcttgtatgaacgcgtacaaatgcacgctctgtccgcgccgatgcggtgcggacaggacgcggacgacaggtttctgcggcggcgcaaaccatgtccgcgcagcgcgcgcagccctgcatacttgggaggaaccgtgcatcagcggcacgtgcggttcgggaaccgtatttttttccggctgcgcactgcaatgctgtttttgtcaaaattatgagatcagcgccggaaattttgggaaagaattgacggtgcagcagctagcggatgtttttctttcgctccagaagcagggcgcgcacaatatcaatctggtcaatccgacacattatgctccctgggtggcgcaggctgtacgtctggcgcgtccgcgtctgcaaattccggttgtatgtaatacaggcggctacgaatcgatggagacgctgcgcgcgctggaaggcgtggtcgatgtttacctgcccgattttaagtatgtcgacgcgcgccgcagcgcgcgttattcaggggcgtccaattattttaaaacagtatcggccgctttgccggagatgctccgccaagtgggggctgtcaaaatggacgcaaatggggtgctgcaaaagggtttgttgatccgtcatctcgtactgcctaagggagtgggagattcgatcgccgttctggaatggattgcgtcaaatttgccacgaaatgaagttttaatcagcctgatggctcaatatacaccgtcgtatcacagcgcgcggtatccagaaattgaccggcgcgtcagcacctatgagtataatcgtgttttgcagcgtgcgcgggagcttgggctcgacgggtatatgcaggaacgcgcttccgcattcgcggaatttacgccgtcgttccgattggaggggctttgatcactctgatcccgatgaataactcaggctgcatggacccggcggtgtgtggctgggtgtgcgacaagcctgttggcgcggctggatttgcgcgggtgatatgtggcggtacgctttgggcggccgcctttttttgcgcagaaaagcgcgcatccaccgaaaaataggagctggaacgccagttcggggaagctgatgccgccggtttcccatgctccgagcgagccgataatcaaaaagacagagatgatggaaagcagttgatacagttgacgcgcgcagtatagcagcttcatatgagtaaccttctttctcgttgtcaaatatggttgttgtatttactataatacaactaaatgtagttgtcaagcgataatttaacaactttttttaaaaatatggattgacatagacaacagataattgtatactaaaagaaataaaatggatggaggatacagaatgttttcagaacgtctgaaggcccttcggaaggaatgcggaatttcgcagcgcgcgctggcgcagcgccttggcgtcagccagcaggcggtagcgaagtgggaggccgcaagttcgacgccggggccgaacgcgctggcgacaattgccgatgtgctgggcgtatcttccgattacctgctcgggcgtgaacgcgattttcaagacggcgcgcaggacacggcgcggctgccggtgcttgggaccgtcaaagctggttatggggcctatgcatttgaggaggattacgggaccgcgcctgcgcaggtgcgtgatccaagggattatttttatttgattgtgcgcggggacagcatggagccgcgtatccacagcggcgatctggcgcttgtgcaccggcagccagatgttgaaagcggcgagttggcggttgtgcttgttgcgggtgaggaggggacgctcaagcgcgtgattaaaaaggagggagcggtcatccttcagccgtttaatcaggcgtatcagccgcaggttttcatcggagaggagcttgaacaactcgtcatcattggaaaggttgttgagacaaaaacccggtggtgagttgcttttcccgccgacatatggtaaactgtcaccatgcaagggtttggaaactgtatgaaagagggaacagccgtgaacatttggcatgatatttcaccaaaacgtatatcaaaaaacgattttatcgccgtcattgagatcggcaagggcggcaaaaacaaatatgagcttgataaggaaacgggcttgatcatcctggaccgtatcctgtacacatcaacgcattatccggctaactatggttttattccgcgtacctacggcgacgataacgacccgcttgatgtgcttgtgctgtgttcagaatccttaattcccctgagtcttgtgcgctgctatccgatcggtgtgatctccatgattgataatgggaagaacgatgaaaagattattgcgattcccttcaacgatccaatgtacaatatgtataagagcatcgacgaacttcctgtgcatatttttgaggagatgcgtcatttcttttcggtttataaagagctggaggggaagcagacggccgttaacgatacggctggcccagaagccgctttggaaattgtccaggcggccattgataattacgtcgaaaagttttgcagggcctgagaaactgcataagaaccggagtaaccacggttttttcaagcaggctttgaagcggattggaaaaggccgcccgatttttcgggcggccttttccgcgcgtgcctattttatgatgcaatgacatattctgttaccattggaggtgacggatatgcagacgcttgcgcttgcgggaaatccaaattgcggcaagacgacgctgtttaataaactgacgggcgcccatcagcatgttggaaactgggccggggttacggtcgagcgccgggaagggattgtgcgcggcagcagtgcacgcttggttgatctgccggggctttattcgcttgcagcctttacgctggaggagcaggtgacacgcgaatttcttcttgacggttcgtatgacgcggtgataaacttgctggacggaacatctctggaacgcggcctttatttgacactccagttatgcgagcttggatgtccgatggccgttggaatcgggatgatggacgaggtacgcgcgctgggcggtgcgattgactgtgacgtgctggcacatatactcggtgtaccggtggtccctgttgcggcacgcagcggggagggagtcggcctgttggccgaagcggcgcgcgctggggcgcgcgccggcctgccgccgcgctatggcgcggcggcagaagcggcgattgccgcagtcgcctgtgtgatctcagagcatatccgccggcctgagcagctgaggttttatgcggttggactgctcgaaaatatgaagcttgccgattcgcttgggcttacaaaaatacagcgccggcacatcgacaggatcagaagcgaatttgaacagcggtgtggggttgatgcggccgcatttctggcgcaggcgcgttatgatgctgtcgatgctattgtgcggcaggcagccggacatgccgcgaagcggccgcatacctggtccgacagattcgatacgttggcgctcaaccgttttctggcgtttccgatctttgcggctgtcgtatccatgatctttacaatctgctttggcggcatgggtcttgccatgaagcgcgctgccgagcaattttttgtacaggcagcggattttctgcgcagggcgctgcctgaacttggtgtatcaagtttttggatcgggcttgcggccgacggcgtggtcggcggcgtcggcagtgtgcttgcctttttgccgcaggttgccttgatctttttgtgcctcaccatattggaggaatgtggatatctggcgcgggcagcttttttgatggactatttcctgcggaggatcggattgacgggcaaatcctttattccgcttttgatgggatttggctgtacaacatcggctgttatggcggcgcgcacgctgggcagcgaccgggaccgacgcatgaccatccttttgacaccctatctgtcgtgcagcgcgcggctgccaatctatgtgttgctgacaggcgtattctttccatcgcatcagggtgcggcggtggcgatgctctatttgcttgggatcgcggcagcctgcgctgtgggtttctggctgcgcacaggtccctacaggacatacagcgcgccatatctgatggaattgccgccgtatcgtgtgccgtcgctgcggaatgtattgcacagcacattctctaaatgcggcgattttttgcgtaaggctgggacattaatatttttattgagcgtcttgatctggatgatgcagcatatcaatctgcatttgctatggaccgcagacgcattacagagtatatttaccgctgtcggaaacgcactcgcaccgctttttcggcctctcggctttggaaatggaaaggcggctgtcgcgttgctggcgggactggtgtcaaaggaagccgttgtttcgtcgcttggcgtggcgtgcgccggcgcacattcttttgaaacggcgctcacagagctgttcactccgctttcagcggcgtcgtttttaaccttttgcgctctttatgcgccgtgtgtttctgcattggcgacaatgcgccgcgagctgcactccatcaaaacgacagtgatcgccgctgtttcacagatattggttgcatatggagctgccttggccgtctatcaaatcggcttgttgtgtcaaagagtgctgtccagttttccgtagcctgcctcgctgtcctttaaaaaatgtgccgcaatctataaaaatgaaagaaattaaaaaaatcctgcaaaaagcgattgcaccggcggaaagtacgcgctatactgaaatacagcggtttagggtttgattgaaaatagagaaattagcccttggactttccaatgacggaggacggattatgaaagtaaaattgatggtacagattgcaattgtattcggcgtttgcctgctcggagaggcagtggcgcaatatatgccggttccgttcccggcaagcgtgacagcgatgctcctgctgctcgttctgctgctggcgggcctgctgcgtgtcgagcatgtacaagaaaaaacggactttctgctgaaaaacatgccgttcttttttatcccggcaagtgtgggcgttatggaatattttgatgttctgcggcgttgtctgctgccgctgcttgccgtttgcttcatcaccacgattgcaaccttttttgccactagcttcaccgtgcgcgcggtatcctgcttgcagcggcggctgacgcgccgcggggaggcggaatgatgaaggcggttctggaatccccgctgtttgggatcgttttgagcatccttgcatatgaagccgggctatgggtcaaccggaagctgaaaacgccgctggctaatcccctgctgattgcagtcaccttgattgtcgggctgatgatgctgtttcatatcccgctggaaagctatcaaaaaggcggcgacttgattgccttattcctggctcctgccacagcgtcgcttgccttgtcagtctacaatcaacgcgggatactcggtaaaaacctgctgccggtgattgctggatgcgcggtgggttcggctgtttcgatgggcagcgtttatgcgctttgccgtttatttaagctcgacgaagccgtgactgcttcgttgatcccaaaatctgttacgacgccgatcgccacggagatttccgcgcagcacggcggcattgtcccggtgacagtcgcagctgtgatcattacaggtatgatcggcgcggttctggcgccgtatatgatccgtatgttccatgtcagaaatccggttgcggacggtctggcaatcggtgcgtcaagccatgcgctcggcacaagccgggcgctggaaatgggagagctggagggcgcaatgagtgggatcgctgtcggcgtttcagggcttttgacagttttattttcccttgtacttggctgaaaaagccatccagacgtgaataaagcggcgtccccttaagggacgccgctttgctttttcttattttgcatattcgattgcgcggttttcccggatacagtgcaccttaatctgaccgggataatcgaggtcgctctcgatttttttcacaatatcgcgtgcaacaatggtcatttggtcatcagagacgacatcaggcttgagcatgatacggatttcacggcccgcctgaatcgcaaaacacttatccacgccgtcaaacgagttggcgatctcctcaagcttctcaaggcgcttgatgtaattttcgaggttttcacgccgtgcgccgggccgtgccgccgatatggcgtcggcggcctgtacaagacaagccacgattgttttgggttcaacgtcgttgtgatgggcctcgatcgcatgaatgatgtcggcgttttctttgtacttgcgggccagatcgacaccgatctggacatgggagccttcgatttcatgtgtcatcgacttgccaatatcgtggatcaggccagcgcggcgcgcctgcgcttcatccgcgccaagctcggcggccatcatgccggcaagctgtgaaacctcgatcgaatggctaagtacgttctgtccatagctggagcggtaacgcatccggccaagcagacggattaactccggatgcataccatggacgccgcactccataacggcgcgctcgccgtcctgcttgatcttgccctcgatctcgcgccgcgccttttcaacggtttcctcgatgcgcgcaggatggatgcgtccgtcctgaatcaggcgttcgagcgcgacacgcgcaatttcacgtttgacggcgtcatggctggaaagcgtgatggcctccggcgtatcgtcaatgatcaggtcaacgccggtaagcgtttcgagtgtgcggatgttgcggccctcgcgcccgatgatccggcccttcatctcgtcgctcggcagcggaacgaccgacaccgtaatttccgcaacataatccgcggcgcagcggccgacggctgccgcgatgatctcctttgcgcgctggtcggcttcatccttgagctggctctcatattgattgatccgcagcgccttttcgtgcgtcagttcaccctcaagattggcaagcaggtaatttttagcctgatcggccgtaaagccggagattctttcaagcatttcaaactggcgcgccttgacatcctcggcctcctgcagcttgacatcggcctcgcgcagcttgttttgaagcgtctcctcctttttttcaaggttgtcgagctttttgtcgacagactcctccttttgctgaattcggcgctcaaggcgggaaacctccgaccggcgttccttcatttccttttcattatcctgcttaagcttgtagatatcgtcctttgcctcaatgatcgcttcctttttcttggtttcagccgacttgatcgcatcgctgatcagacgctttgcctcctcctcggcagatccaagcgccgcctcggccgattttttgcggtattccacacccagaaaaaaagcaatgacagcacccaccaaaaaggagatgatgatgccaatgacaaagggaatgattccgattgtgctcatttgggaacaggccctcctttatgcaattttcaatgtccgcaacccgccctgcaaaaccaaaaagcccggccgcgcgggcatagggatacgcaaagcggatagaatatttatcaggtaggcggtttgattcacgtaaaatttacgaataattcaaagctgcgttaccgttaaacatactgcatgacaatacttattttatatgtattttgtataattgtcaagaaatattgtgtatttaagcgggttatcctatctaatatgcgcggattgatacggcgtgggcgaattgacagttgacaggccgccgcggccgtgctaagatgaaaaaaagtctgatatcacctaaaggcaatgacggggaacacaaccaaagtacagcctgttcacagagaggcgcggcgcctgctgaaagccgcgccgtccggtttttggcggcgaccgccccctgagcgcgcgcgatgagcgcgccggctgatcccgttaaagatcgcttgagcggcgcgtttgcgcaattcgggtggaaccgtggagcctgccttcatcccgttgtgggatggggcttttttattttgattttcgccgtaggctcattggagccggttgataaaatctcctcactcaaaacagcggcgctttattccggcatatttacaaaaaaagtttgtgaattcacggaggcttgcctgtgttttttgttttatctgccgaaaaaatcgttcttgtttttggcgcggcttggtttgtcaacaaatcccatttgaccggtctgtttttcgcagagaaaggatgctgaaatgatgataaatgtaacgttaaaagatggcgttgtcaagcagtacgagcagggcacgacagccgcggaggttgcaaagagccttggcgcgggactttataaagccgcctgcgccgcaaaggtggacggcaaagccgtcgacctgcgcacgccgctggagagcgactgtacgctttcgatcctgacctttgatgcacccgagggcaagcacgcgttttggcacacggcttcgcatgtgttggcacaggctgtcatgcgcctgtatcccgatacaaagtacacgattggaccggctgttgaaaacggcttctattacgatttcgacgtcgaaaagccctttacgcccgaggatctggccgctattgaaaaggagatggcagccattgtgaaatcaggcgtggagcttgaccgcttcgagcttgacgcgccgcaggcgcgcgagctgatgaaggaccagccgtacaagctcgagctgatcgataagcatgcggcaagcggcgagaaggtcagcttttaccgtcagaacgatttcaccgacctctgcgccggtccgcatctgatgaacgtcgcgccgctcaaggcaatcaagctgctccaaagcacaggcgcctattggcatggcgacagcagcaacaagatgctctgccgcgtatacggcattgccttccccaaggcgagcgagttaagcgactatctgcacatgctcgaggaggccaagcgccgcgaccaccgcaagcttgggcgagagcttgatctatttgatatctatgaggaagggcctggtttcccattcttcttccccaaaggcatgatcctgcgcaatctcctggagagcttctggcgcgaggagcatcaaaagcacggttatcaggagatccgcacgccgctcatcctcaatgaggagctgtggcaccgctccggtcactgggatcattataaggacaatatgtatacgacgaagattgacgaccgtgactatgcgatcaagccgatgaactgtccgggcggtattctggtctataagcgccgcatgaattcctaccgcgatctgccgcagcgtcttgcggagcttggcattgtgcaccggcatgagctttccggcgcgctgcacggtctgatgcgtgtgcgctgcttcacccaggatgacgcgcatatctttatgacgcccgatcagattgaggcggaagttctcggcgttatcaatctgatcgacagcatctacagggtgtttggcttcgactatttcctggagctgtccacgcgtccggaggattcgatggggagcgaggagcagtgggagacggctacggccgccctgcgcaaagccctggaggacaacggcaggccgtacacagtcaacgagggcgacggcgcgttttatggccccaagatcgattttcacctgcgcgattctatcggacgcacctggcagtgcggtacgattcagcttgatttccagatgccggaacggtttgatctggcctatatcggcagcgacggcgaacgccatcgcccagtcatggtgcaccgcaccgcatttggaagcatcgaacgctttatcggtatcctgattgagcattatgccggcgcgttcccgttgtggctcgcacccgtgcagatcaaagtgctgccggtaacggacgagcatatcccttatgcgcagagcgtagccgataccttgacaagggccggcctgcgcatcgagctggacagccgcaatgaaaaggtgggctaccgtatccgtgaagcgcagctccagaagataccgtatatgctggtgctcggcggcaaggaggctgaaagcggcgaagtcgcagtgcgtgaccgccgcgatggcaagacgacgacgatgctgttggcggactttgtggagaagatgaaaacagaggtcgagacaaaggcgaactaaatcgtttgaccgtgcgtggagggcgttttgaagcgccttccgcgctttttttgttccggaggaaacaaaatattcatattgtgtcgaaaatttcgccatataattcgtgtttactatacaaatacggagtcttgtcggcttcctgcgcgccttttaatcggtccagggccgattggacttgccattgtgcgcgtttcacggtataataaccgcagagcggttattataccgtcttatgcccaacggctcgccgcttacgcggcaaccgccttctgatgggcaattataccataccgcttcgcggacatggtataataaccgcagagcggttattataccgaggttatggccaaggcgatacgcgggcgcgcttacgggatatcacaggatttttcattaagaaatccccattgtgtccgggtttctcaactattgtgaaaacttacaccaaggccgttatttccatcggcgtcgtgggcatcgtcgtggctatggttattcagggcatcgtttctcagtggatggatttcgtctccatctatatctgtcctctgggggcgggacttgccggcatcatgttcgcttgggtatgggggcgcaaggctgtggaaagcgccgtgtccaaaggtcgcagcaagccgattggctcctggtactacccgttgtataaatattgtttctgtttgttaactatggccgtatttgtcgccggcattgtctttggcggtatcggctgatccggacgtgtgggttcaagcctaagctaaaaccggatttatcggttttggctgagatacaacagccaccacctaccatacagaaagcccgcggccgtgttcccacggccgcgggctttcaccgcgcttggacgtttgtattacgctgcgaagtactggagcacagcgtcggcgacggcgttgccatatttaaacatggcatattcatctgcgatttcctcatactccgtggggttgcagatatagcctgattcaacaagcaccgccggacaaccggtcatcatcgtaacgcggtaccacgattgttcggtaaaccgcagtttgcggcccgtatcctccgcgaggctccagccgatcttttcagcgagcagctccgactggtcgttataatagtagacctcaataccggaaacttcattggaatcaaccgtttcggagagagaattgtggtggcttgaaataaacatatcggcgtcaaactgttccgccagttcgacgcgttcgttgagcgtcatattttcattgttgtgcaggacatgcacctttgcgccaagtgccgtcaaacggctttctatggcgtaggagtccgccagattcaagatattttcaaatggtccgttttggccgggaacgccggcggcgccggggtcgtcgccgccgtggcctggatcaagcacaaccgtgatgccggaaagcggctttgccgaagcgcggtcaagcgtcggccgctgcttgagataaatcacggtgtcgttgtcattgaaacgaacgtcccagccgagcaaccgcacgccttcgtttaaatggaatgtgagcgtcaccgtgttctgctccgtactgctttcaatcgatgaacacagcttgctctcaagcgcggctgtgctcaggttttcaaaaccggtgacattatacagacggattgtaacgctgtcatcgtccattgcgccgtcaaacgcagggcgggcagttccgcggattgtaagtttttcccctttatccgtttgctccagcgaaagcgaggaagcgtttgtttccgctgtctgggagccttccaggatatcgaccgcgcccttgagcacatagccgcccgatgatagatgataatatccgccggcattctccgtgatataatcgacgcagtcctccttgaggatggttgcatattcgccgtcgtcggcagcgttggcattgaccggtacaatgaacgttttcataactgcaacagggcgtgcgccgtttccacaggcgtagacatcgccggcagattgctgctcggaattgacgccgccatattcaagcgtatatgtgaccggcccgatatttttgacctcgccgtcctgtgcgagcgaagaaacgtcgatggttgcctgataggtgacagcgacgccgtccgccgcctgtgcaaccggctcaagcgtcgcggccagcccgccaaccgacgcggtaacggttccgccgcccggcgcggtacacgagagcttgagtgattgtccggggagcacggcttcggcattcgacgggtagacggagcttttcacaatggcgctgatggccgcagatgcagacggctggttgcgtacaatggtagccgtcttgttgacgccgccctgcgtaaaggtataggtgttcgtaccgtatggcacattgaccagcacgccccacagtccggagggagaacgggcgatctcagcgccgttgtagaatactggcaggcttgggtcggacgtgccagtgatgaagtagctttcccaatccgaaccgacagtcagcgtttctgtcggacgcgtcacagcaaattctgtgctgtaggtaagatcgggcatattcgcctgctcagtctgtgcaaacgatgcagccagggaataagcggcggcgcgtgaatcggtgtgcagcgcggaaaagctgctgacaaccaggccgctgccggacgtgcgctcctgatagagaatcgcgtccgccaggtgggtaaaggccgtgtcgtcgctcgcgatatacagcggatagtatgggacgccggaggtctgccagaccgccagcacgctgggtaactcctgttcggtcagtccggccaaatccgggacggcaaaatcaagcgcgccgctttccgcaagcgcggccgcgctcggggacgcgcttgacgggagcagcatgcctaggcgttggccctcctttagacgcagggcgctgcgcacctgcgtggccgtttcggaaagcgcggccatatagttgtcaacagcggcaaaaccggccggctccacgccttccagcacgatacccgcgatgtcatagcgggtggcaagctcggcggccacagagccggcaagctgctgaacgcccagctctgtgggattgaacctaccgtctgccgctatccactccggattttttgatgcgggcgaggactcagcaagatcctcggctgacacggcgaacggatcgatcatcgcatagacttggatgccggattccttgcacacattcacaaggtaatcgagcgggtcaaaaaatgcgaacgcaccctgttcccccatccaataggcgctggaaggcaggattgatgagcgatatagcgcgtcacaggatggaacggcttcaaagaacacagcgttgtaaccgtattccccggcaaacgcggcgatttcatcgagctgcgcgcgctgctgcttcgcggagagtccgggcgcggatggaaagtcggcgttgccgcgtgtgcggacaatcagcgcgtgcaattgctctccggcggcgggaatgccggcgggcggcgttttggaagaaataggggaggtcaacaggtcgctggcatacaaaacggcgcaggtggccgcgacgatcgccagggacgccagcagggtgcgcaggatggttcgttttgtctcgtgcttcatgaatctgttcctcaattacaatttaaaatcggatggatcaaaaaccggcagcgcattaggccgtttgggcacgcgctttagcggcgcatagcgatatttccggcaagaggcatgcggcgcagtgacgccgcgcttttcgcacagcacggtttcgcccgagcgtgtgataaacccatatttacagtattggcaggccggcggtatctcattggagaaaagctgtgagcggcgcatggcgctccctcccttcaaataacttacaaagtgtggaatcgaccggctggagatcgaatgaaatttttgcttgttcttgtttcgaattctcccggtacaattcagcattgtcttattatacaggattcgacgccttatttccatatacaaatctttaacagtcgggttattctgtcatacggatccttttacgcggtccatccggcagcagaatggcacacatacagatcaggcagagcgccgtaaccagccggttcggcgtatctgggaccgctgctgcacgcgcgctgcccgcagccattacagagagcgtttgcgctggaagaagctgatagaacaaattggccagtaaagcggtgattgcgccgtgcgccagccgcgagcggtaaaacggcccgaaacgcggaaggttttcctgggaaaaacaggcgcgcacctggaacatgatgcttagagaggagaaggaggtgagaaatgcgcagagcgtaaatccggcgcgtccgccaagcgcgcttgcctggatacagccgtttgtgacctccagcgccccggagagcacggcggaaaaaaacggcgcgccgagcgccggaaacagtgcgccaagcgattgagccagcacaccgaccgcgccgaccgcagaaagcaacgctgtgatggctgcaaatgcgacgacaaacgcgcagacagacagcatggaggcgctcgcgctgcgcaccgctgctacaaaggctccgtgttcggagggaaaacggtgatgcggaccggctgccggccggcccgcatgagcgcctgaaaaaacaaacgcgccgacaataaaggcgctgagaagctgtgcggcgagcagcagaagccctgcggtccggctgtgcagaagtccggcgccgactgccgaaataagaaaggacggccccgcgttgacacagcagcagagcgcgcgcgatgcggtatccctgtcggtttcgccgcgcgccagcatgtcggaaagcatacgcgccccaactggaaatccgcccaaaaagctcatcagaagcacggtccccatgttttccggcatgttgagcacgcggcgtgaaaatacagatacagagcgcgaaagcgcgctgcccgcgcctgttgacgtgatcagtcctgcgagaatcataaatgggaacagtgatgggatcaatacgcccgcgcagttttcaagtcccgcccggacgcccgcggcgacctcctgcgttttccacagcaggcatatggcggccgccgcagcggcgcccgccccaagaaaatggcttcgcctcatataccgcaaccccttattacataaaatggccggtccgttaatatgtatgtaacgaacggtgaaaagaatgataccgaattttatatcccgccatgtggcgggatggggaacagggggaaagcctgtgtttggacacagaaaatcgaagccgcggcgcggtacaatcgccgaggttgtgtcgcgttcgctggagatacccgtcgatgtagccggtgggcttgcgcaggtggagctgcttggcaaccgggaagcggcaatcgagcattgccagaatgtattggaatataacgacgatgtgatccgtctgaacacgggcaagctgatcctcaaatttaccgggcgcggtctatcgctcaaatgcatgagcggcgaccgggtcacggtcacgggatttttcacgtccattgagttttcgcagtagagaaaaaacagtatgaagcatttcaggggggcgggagtttgctgtttgtaagactgctgcgctggctgcgcggttatgtttgtttttcggcgcggtccggttctgtggagcggctgatgagcctgtgcgcgcatcatcatattgtcctctggggatgccgccgtacggaaaacgggttcacaggctttacaacggcgcgcggataccggcgcttgcatccatatgcacgtaaggccggtgtgacggctcgcgttggcaggcgatatggcttgccgtttctgctgtaccgataccgccggcgcactggtatcgcggccggcgtgctgatctgtattttgttcttaatcatttcacagcagtttgtgtgggtggtgcgcattgagggaaatgagcgcatcgattcacaggtgttgtatcaggcgctcgaggaaatgggcgtgcgccgcggtacgcgcaagggtgcgattgacgagcgtgagatcgcgcgtgcgctgccagtcgcagtcgatgggcttgcctgggcggcgctcaacatacagggaacgacggcgacgctgctcgttcatgaacgcaccgacccgccgccgaaaattgatacgaatgtcccggccaatgtcgtggccgcagccgatggccagattgtgcgcatggaggtcacagatggccgcgccgccgccaaaataggcgacgctgtgcatacaggcgatatcattgtcagcggcatcattgaggatcgctggggtatgacgcatcttttgcgcgctaacgcgcgcgtgttcgcgcgcgtgccgcagacgcttgaggcacgcgttccgcttgtgctcgaggagcctgtgccgacgggccgtattgtgaaacgccgttatctggagcttgccggcgtgcgcctgccgctgtttatctacagcgggctggagggcgattacaagctggagcgcgtgacgagccagccaaaagctgggccgatcgatctgccgttttgcgtgacacgcgaaacatacattttttatgaattacagaaggaacagctcgggcagcaagcggctctgcgcctcgcacagcgccagcttgaggcgttggagcgcgagacgtgggatcaggacgctgtgaaaaagcgcgacgtatccgcatcggtggaaaacggcgagcttgtgctgcgcggcgattatattgtggaaatggacatagcgcggcaggtcgagataccggtcacacaatacagccaggaaaaagatgagaaaaaaccagcgcgcgccggcggttactgaccgccggcgctttgccgtctgaggaccaatcaagatggtttcaatagtttaaaaactggagaaatttcacaaaatattcacaaataactggtgaaactgcttgttatttgccaatcaatttgctatactatacgcggggtattgggtgttgttaagagcaggaaacggactaggggctgtttgcgaaaaatttggttatttctctatttttaagcaagccccaggcaaggggacgaatgaaaaaacatgatagagcaactggtaaatatagaccggatggagcatgcgctcgctctgttcggcagctttgacgaaaatgtccggctgatcgaacaggagtatggtgtgactgtcacctgccgcggtacagagatcaaggtctttggcgacgagcagggcgtctcgcttgccgtgcgaacgatcacgggcctgctttcgcttattaacaagggcgaaacactcagcgatcagaacgtgcgctatgtcatggcgatggtcagcgaagggcgcgaggacaaggtcgcttcactcgccgacgacgttgtgtgcatcacgacaacgggcaagccggtcaaggcaaagacgctcgggcagaaaaaatatatcgagatgatccgctccaatacgatcacaattggcgttggaccggccggaacgggcaagacgtatctggctgtcgcaatggcggtgcgcgcgttccgagcgcatgagatcaaccgcatcatcctgacaaggccggccgtggaggcgggagaaaagctcggttttttgccgggcgacctgcaaaacaaggtcgacccatatctgcgtccgctgtacgacgcgctgtttgatatgctcggcgcggaaaatttccagaagtatgtcgagcggcagaacatcgaggtcgcgccgctcgcttacatgcgcggacgcacgctcgacgacagctttatcattctcgacgaggcgcagaacacgacgccggagcagatgaaaatgtttctcacacgtcttggcttcaactccaaggcgattatcacaggcgatgtcacgcagattgatctgccggacacaaagcgttcggggcttttggaggccgtcaaggtgcttaaaaacgtcgacgacatcggcatcctgcattttaccgaaaaggatgtcgtgcgccaccggcttgtgcaggcgatcatcaaagcgtatgagcgttattatgaggagggcaaacgcaacagatgacggaacgtgtaaaggtcctgatttccaacaggcaaaaggatgttaaaataccaagcggaatccgtctgctgatccggcgctgctgccatgcggtgctgatcgcggagaatttccatgaaagcgctgaaatcagcgtcagctttgtcaacaatgagcagatccgccagctcaatgccgaatacaggcagaaggatgcgccgacggatgttttgtcgtttccgcttggcgccgatggcaaatatgaccgcaacatggagacgggcgcgcttcagcttggggatattgtgatttcggtggagaaggctgtcgagcaggcgcgtatgtacggccattcacttcagcgtgaaatcggctttttaacggttcactccatgctgcatctgctcggttatgaccatgaggcgggcgggcttgagatggtgcgcatgcgcgagaaagaggaaagcgtgctggcaagcctgggccttgagcgcgacggcagctacgttttgccggaagatgttaaataaaatagccgcgcttgggcgcagcttcggatatgcgctgtgcgggatcgcgcactgcatccggagggaacgcaatttccgtatccatctcgtcgccgcggcgtacgttctggcgctcgcggcgtatctgcgcgtcgttggggtgcgcctcgccttgctgttgctgaccatcggcggcgtgctcgcgctcgaactgatcaacaccgccgccgaggcgcttgtcgaccttatttcgccggagcgccgtccgctcgcgaagattgcgaaggacacggccgccggggcggtgcttgtgttcgcgtcggcggccgtcggcgtggggtttgcgctactctggcagccgcgcgcgcttatgacgctgctgttcgaaacgcttacatcgcccatacgctttctgtcgctggctgtttcggcgctgatcgcggtgtggtttgtattcggattcccacagagggaccgccaaaaggagaacttatgaatttaacacaaccgcaatatgagacaaaatcggcttttgtcgccattgtcggtcggccgaatgtcggcaaatcgagcctgctcaacgccttggtcggtgagaaggtggcaatcgtttcgaacaagccgcagacaacgcgcacgcgcattacgggcgtactgacggatggtgatacgcagcttgtgtttatcgatacgcccggactgcataagccgaggacaaaactgtcggaatatatggtcaggcaggtgggcgacagcgtggccgacgtcgacgtcgccgttcttgtcgtggagcctggcgatgtgattcagaaggccgagcagagcctgatcgattcctttacggcgcagcgtatcccggcggtgcttgtcatcaacaaaatcgatacgctggccgaaaaggagaagctgatggcgcaaatcgccctgttcatgcgggcgtatgcgtttgaggcggttattccggtttcggcgctgcatggcgacggcgtcggcaatgtgctgtccgagctgaggcgttttgcagctttgtcgccgtttttcttcgacgcggacacgctgaccgatcagcccgaacgcgtaattgtggcggaaatcgtgcgcgaaaaactgctgaggagcctgtttgacgaggtgccgcacggcacggccgtgtcggtcgagtcgatgaaggagcgcgcggacaaggatgttatggatatccaggtgcagatttactgcgagcgcgaaagccacaagggtatgatcatcggccgcggcggtgcgatgttaaaaaagatcgcgtcccaggcgcggcaggatatcgagcattttctcggctgccgcgttaacctgcaatgttgggtcaaggtgcgcgaggactggcgcaaccgggaaaatatcatccgctcattcggatacaattgaccgtctgccctgcgccgctgcttttcaaaagcgacgcgctgcaggcgggcaggacttgaaaacgctgtcaagtggtaaaatagtggaaggggagcaaagctttccctacgataagcggcaggatgcggggaacaatacaaccacacaacatttttggaggtggcggtgttgaaacccgacgaggcgatggcgtttaatacatttttacagtccggaaaaatcgaggattacatgcgttatgtcggtgtaaagcggcaggcgcaggcaactgcggcgaaaaacgccgcggccgcgggggaaaacggtgcatatcacaaccgaggcgatcgtcctgcgggcacgatcggttgacgaatttgactgcgtgctgacgctcctgacaaaggagcgcggcgtcatatccgcctacgcacgaggcgctaagaagccgcgaggaacgctgcgcgttccgaccgagcttctcagctactcgtgttttgtgttgttttcaaacaaagaacggtacagcgtcgaccgcgccgatctggaaggcgtgttcatgggcgtgcgcggcgacgtgtgcaagctgtctttggcgtcgtacctgtgtgaattgacggctgaaacggctccgcgcggcgagagcgcaggggagtacctgcgtttgctgctcaattctctttatatgctcgaccgggataaacgcgcctgtgcgtttatcaaaccgctgtacgaactgcggcttttgacgatggctggctatatgcccaaccttgtcgcatgccgcggctgcggctgctttgaatcggagctgatatattttctgccgctgacgggcgagcttgcctgcggggagtgtatcgccgatgcgccgccggaccagccgcggatgcgcctttccgccggcgtgctggccgcgatgcggcatatcctgtatgcgccgtttgaacggctgttcgcctttacgctgccgcaggagcagcttgtatatctgggggaggtcacacagtattatgtccaggtccagctcgacaaacgcttcccaacgctcgatttttacctgacgatcaaggattagggcctgttttgccaaacagaatctttcaggcggcacaggccgttacaggggacggaaaatggataaatattgtaaagcaattgaattggataaggtgcttatgcgcctggcgcgccattgttcgtgcgaggacagccgcgcgctggcgcttgcgatcgaaccggcgcgcgacatccgcgatgtgcgcgagctgatgcggcgcacggtcgatgcgaacacattgacgaaccgttactccacgccgtcgatcggcggcgtgacaaattgttccgccgcgctcaaacgcgcggcggtcggggcgcgcctgtcgccgcgcgaactgctcgacgtggcgcgcgtgctgcgtgcaattgagacgatcgaacgctggcgcagccagcttgagggcgatccgacaagcctggaatttttgctcgactgcgttgtggcgctgccgtcattgcagcgcgccatatcgacggcgatcgtaacggaggatgaaattgccgacgcggccagccccgcgcttggagatatccgccgtaaaatccggagcgccggcgcaaaggcgcgcgaggtgctcgaccggctggtgcgttcggcgacctatcagaaatatttgcaggaaaacatcatcacgcagcgcgacggccgctttgttgtgccggtgcggcaggaataccgcaacgagatcaagggattggtgcacgatacgtccggctcgggcgcgacggtattcatcgagccgatgggcgttgtcgaggcaaacaatgaaatccggattctgcaagggcaggaacaggcggagatcgaccgcatcctgcgcgaactttccgcgcaggtcggcgcgtgcgccgacagcatcggcggcagctatgaagcgatcgtcgagcttgatctttattttgcaaaaagccgtctggccgacgagatgcgcgcgaccgaaccggcgatcagcgaaacgggcgctgcggagctgaagcgggcgcgccatccgctgctgcccgcggatcgtgtcgtgccgattgacctgcggctcggcggtgattttgacacgcttgttgtcactgggccgaacaccggaggcaagaccgttgcgattaaaacgctcggtttgctgtcggcgatggcgcagtgcggcctgatgctccccgcggccgacgggagcacggtgcctgtttttgaaaagcttttggtcgatatcggcgatgaacagagcatcgaacagagcctatccaccttttcggcgcatatgacgaatatcatccgaattctggatgaggctgacggccgttcgctcgtgctgctcgacgagcttggcgcgggcaccgatccggtggagggcgcggcgcttgccgtcgccattatcgagcgtctgcgcgcccagggcgcgaaggttgtggccacgacgcattacgccgagatcaaaatgtatgcgctcaatacgcccggcgttgaaaacgcaagctgcgaattcgatgttgcaacgctgcggccgacctaccggcttctgatcggcgtgccggggcgttcgaacgcgtttgccatctgtgagcgcctcggactgccggccggtgtgatcgaagcggcgcgggcgcatgtttccggagaaaacctgcgctttgaggaagtcgtctcgcagcttgagcagacgcgccaggaattggagcgcgcgcgcgtgcaggccgaaagccagcgcgccggcgcgcagcgcgagcgcgacgaggccgacgcgctgcgcagggcgatggagcaggagcgcgagcgtgagatcgaacgcgcgcgcgtgcaggcgcgcgggattgtggagcaggccgggatgcaggcgcaaaagctgcttgacgagcttgacgaactgcgcaggcagaaggacagcgccggctttgcagagcgcgctgcgcaggccaaatctgccttcaaagcgaatatgcgccgtttgcacgacttggccgatccggtgacgcgcaaaaatatcgaacagtacacgcccgagcgcccgctcaaacgcggcgacacggtgcgccttgtatcgcttggacgcgaagggacggtcctgtccgcgcccgatgggcaggggtttgtacaggtgcaggccgggattatcaagacgaaggtgcatcagtcggagctgcgccttgtcgatacaaaggacaggcacgtgacggtcggcggcgccggcgtctcgacgcgcggcgtatcgtcgaaagcctcgcgcgacgtgaaaacggaggtggacctgcgcgggatgacgaccgacgaggcgctgatggagcttgaccgctttatcgatgcgagcgtgctgtcgaatgtgccgaccgtcacaattatccatggcaagggtaccggcgcgctgcgcgccgcagtgcagcagcgtttgaaaaagcatcgcagtgtgaaatcgttccgccttggtacgttcggcgaaggggagtccggcgtcaccgttgcggaattgaaatgatgccgcgctttacaggcagccttgtttatggtatgatataattaggtgggaaatgattgattttgatagattgcgagtgatgaaggtttggaaaaaaaggtgacgaaggctggcgcgctgacatataagggccgtccgcttgtgcgcagtgggaatacaatctattacggtgacatgggcgacaaatatgttgcgatgctacagatcctggcggaggcgccgtttgagggcgaacagcttccgagcaaggtttccgtgcagatctggtcgacggacgacgagctgcggccgcgggatcgcgttgtgaaaaagacagagaaatcaaatttgtacgacgcgcttaatatcgcgtcgatctggctggagcgccagctttccggcaagtaaactgaaaaaggcccggtaacgattgactcgttatcgggcttttgtgtaaagactggaggatatagccatgacagaactgcatcttcatctcgacggttccatgcggccgcagaccatcttcgagctggcgtcgcaccagagcatcgcgctgcccgccgcggatgcaaaggctctgcgcgcgtatctcgaggtaccggcggactgcccgtcgctgacggattatttaaaacggttcgatctgccgcttgccgtgctccagacgccggacgcgctggagcgcgccgtattcgaactgtcggaggacctctggcggctcggcgtcgaccgggcggaaatccgttttgcgccgcagttttcaacaagcgatggcatgacgcaggacgacgccgtgtgcgcggctgtcgccggggcgcgccgcgcgatggaaacgtatcccgcttttcgctgcgggttgatcttgtgctgtatgcgcggaagcggcaatatggccgccaatgaggaaacgctgcggctcgtcaggaagcatctgcccggcggggttgtgtgcgccattgatctggccggcgcggaggcgttgtttccgacatccgattacgccggactgtttgaacaggcccgcgcgcagcagatcccgatgacgatccatgccggggaggccgccgggccggaaagtatccggcaggcgctttccttcgggacaaagcgtatcggccatgggataacagccgccggggatccggcgcttgtccgccagcttgcagaagcaggcgtgacgctcgaggtgtgcccgacaagcaatgttcagacaaagggcgccgtcagcctggagcagcatccgattcgcgcgctgtttgacgcaggggtacgcgtaacggtcaactctgacaacatgacggtatccaatatcgatctgccgcgcgagattgcgcttttaaaaacacacctcggttttaccggcgaggagatcgggacgatgcagcgatacgcacgcgaggcgtcgtttttgagagactgaaatcaaagcggcgccatgtataaaagcggctcccgcgccagccaaagctggtgtgggagccgcttttatacatgaatctatccgcatatgttcagtcggccgcgccctgctcgatgtgcgggatatcggtcaggccaagcagaaaatcggtggagacattgaaataagcagaaagctttacaaggaaatcgaatgaggcgctgatgccgcctgtttcaagctctttgacattctgtgcagtcaggccgatggcctgcgcaacctcctcaacggttttaccctccgccatacgtaatgcattgagccgttcgccgaaggactttttgttaaacacgggagaagcctccttaatttaagtctgtgtttgataaccggccggtggccgtttgataacagtatatgactgctgcaggctgataagttaaaggaatccgccgtcggccgcaatgacctgcccggtgatgaatccagcgccctcggacgctaaaaacagcgcgagccgcgcgacatcctccggcgttccgagcgtaccaaggggcgtttccagccgcagggcctcgagcgactctggatcaagctgtgcgttcatgtccgtgtcgatcacacccggcgcgatacagttgaccgtgatcccggaagggccaacctctttggcgagcgcctttgtaaagccgatcaccgccgctttggatgcggaataatgaacctcgcatgacgcgccggaaattccccagatcgaggaaacgttgacaattcgtccatactttctgcggatcatttgcggcagaagggcacggcagatataaaacatgcctgtgacgttgacgccaagcatacgtgcccagtcctccgccgtgatatcgcaaagcagtttttgctgtgcgatgccggcgttattaatcaccacgtcgatatgcccaaagcgttccagcgcctgcgccgccgttcggactgcctgcgcttcgtccaacaggtcagcgcgaaagagcgccgcgtcgcagccggcggcggacagctcgtccaggagcgaacgtgcggccgcttcattttgatgataacaggcggcaacgccgtagcctttgcgtgcaaaagccgcagcgcacgccctgccgattccgcgtgatgcgccggtgatcaatacggtccgagacatgtaagccctccatagacaaaagcctccgccataagcggagactgcttgtataccgtccgcatccatctgtggggcgcgcaaatcacgccgcacagacgatacagacaggcattaatcgttcagatagctcttgaccagcatttgcagcagctcgtcgcggtcgattttccgaatcagactgcgcgcattgttgtgcgtagtgatataggtcggatcctccgacagaatatagccgacgatttgattaatgggattataccccttttgacgaagcgcgtcatacacctcggttagaatggccttcatctgctgctctttatcctcatgaatcgagaaagatatggttggctcgtgcatggctttcacctcgtttgggcaagttaaaaatacacagaaacaggctcgttaatccctgtccttatgttccccattttacaacatatttcgccggatggcaagtgtataaaacctggaggctgtttaaaaaataaaaattcctctttttggattttttaacatataaaatgtattgtacataaaaatcaacgacatgcggcaatcccaatcatttaccggctgcatcattcagaattgaaaaagctctgaggaagtatctatgctattgtatgggactgccggcgcaaatattctttgggatatttgacaggtgcgtaaagtaaaaagagcggccgcgcttttgcgcggccgcttcggttgcatatatcaataagccttaactgcgcagctctgcaccgatggttctgagcgccttgagcgcgcgctttacagcggcatcggactcctcgtcggtgagtgtgcggtcggccgcgcgcatcgtcagcgaataagcgacgctctttttgccatcggcgacctgcgcgccgcggtagacatcaaacagcgtcaattcctcaagcgtgctgccgacggcagaacggatcgccttctcaagcgcagcgaccggcagcgcgtcgtcgcagattaacgccaaatcgcgcgtcgcggcaggaaaacgcggcagcgggctgtaaccgcgctcgggcgcgacattttcaaacaggacggtttcgtccagataagcaatgtaggcgcgtgtgccaatctgataattttcacagacagccggatggacctcgccgatcataccggcgcatttgccgccgatcagaacccgcgcgcagcggccgggatggaacgcggcgtcctccgcgctggattcatattcgcaaccgtccacacccgccgcgcgcagcagtgtttcaacaatacctttgagcgcaaagaaatcgtatgcgtcgccataaagtccgagtgtaatcaccgggcgctcgtcaggcagctctcggccctcctgcggcagatagacggtgccgatctcatagagcgcggcggccttgttgcggttgttgtaattgcgcgcgagcacctcgagcatcgacgggacggttgtggtgcgcatgacgctcgtgtcctcgccgagcgggttttggatggtgacgcaggcgcgcagcgggctgttggccggcaggttgattttatcgtaatatttagggctgatgaaggaataggtcgcgacctcgtaaagcccttgggcgagcagcgtctgattgatcaggcgctcaaatttctgtttggccgtgtaaccgccgtcggctgtgccgcggatggctgtcaccgggattttgtcatagccgtaaaagcgggcgatctcctcggcgatgtcggccttgtgctccaggtcgctgcggaaggagggcggcaggatatcgtcgccgtcgattttgcattccaggcgcgtgaggatgcggcgcatctccccgacagggacctcgatccccaggaactggttgatccactccggttcaagcttgatacggcgcggctcatgacaggcgttgtcggcatcgatcatgccgccgatcacctcgcccgcgccaagcagctcaacaagctcgcaggcgcgctggacagccggaatggtggtggcggggtcgagctgcttttcaaagcggccggacgcctccgtgcgcataccaagctttttggcggtcgtgcgcacggacgggccgtcgaaacaggccgattcgaacacgatcatatttgtatcgtccatgatgccgctgtattcgccgcccatgacgcccgcgaccgcagagggcttggacacgtcggcgatgacgagcatttcaggggacagcgtacgcgtgacgccgtcgagcgtcatgatggtttcacccggcttggcgttgcgcacaacgattttgccgccttccacatacttataatcgaacgcgtgcatcggctggccgtattccagcataacatagtttgtgatatcgacgatattgttgatcggacgcacgccgctggcgcgcaggcgctcgcgcatccagcgaggcgacggttcgattttgatatttttgaccatgcgcgccgtgtagcgcgggcacagcgcgggggctgtgacctcgacggaaagatagctgtggatatcgccggccgcgcctttgacggcaggcgctttgatgttgagcggcttatcgaacgtgacggccgcttcgcgcgccagccccgtaacagacagacaatccggccggttcgaggtgatttcaaactcgacgcacgtgtcgtttaacccgattgccgactggatatcctgcccgggcgtcatatcaggctcctgtaaaataaagatgccgtcctcgatcgcatacgggaagtcgtgcgttgtcaaaccaagctcggccagcgagcagagcataccgttcgattcaacgccgcgcagcttgccttttttgatatgcgtgccgtccggcagccaggaatcgtgcatggccacggggacataatcgccggcgcgcacattctgagcgccggtgacaatctggatgggcgcgcccgtgccaacatcgacttggcagataaacatatggtcggaatccgggtggcggacgatttgtgttaccttgccgacgacgacgtttttgatctttgcgccctccgtctcatacccttccaccttggaaccggacatggtcatcgcttcggcgaattcgtgggcggtaatcccgccgacatccacatagtcggcgagccatttcattgataaattcatagcatgcagcctccttgcaatcagaactggtttaggaaacgcagatcgttttcatagaacaggcgcagatcgtcgatgccgtagcggcgcatgacgatacgctcaaggcccatgccgaacgcgaagccgctgtattcctcgggatcaatgccgcagatggagagcaccttggggtgcaccatgccgcagccgagcagttcgatccagccctcgcccttgcatagccggcagccttctccgtggcaggcgaagcactgcacgtccaattcggcggacggctcggtgaacgggaagtggtgcgggcggaaacgcacgacggattcatcgccgtaaaggcgcttgacgaacagctccaacgtccccttcaggtcggccatcgtgaccccccggtcgacgacaagcccttccacctggtgaaacagcggcgagtgcgtcgcgtcgaccgcatcggagcggtagacgcgtcccggcgcaatgacacggatgggcggcttttgcttttccatcgtgcgcacctggacaggcgacgtctgtgtgcgcagaatgacgttatcggagatgtaaaacgtgtcctgcgtgtcgcgcgccggatggtttttggggatgttgagcgcctcaaagttgtagtaatccgtttcgacctccgggccttccgcaatcgaaaagcccatgccgagaaagatttccttgacctcgtcgagtacctttgtcaagggatgcgccttgccaagcggcgcggcgcgccccggcagcgtcacatcgagcttttcgtcaatcaggcgttgttccagctgggcggcgcgcacggcggcggagcgttcgtcgattaaccgttcaatggcggcgcgcacctcgttggcgagctgtccgaccttggggcgttcctcagcggagagtttgcccatctgtttgaggatagcggtcagttcgccctttttgccgaggtagcgcacacgcaggtcgtcgatggcccgcagatcggccgctgagtccagcgcctcggctgcctgcttctgaatggtttgcagcgcgttgatcatttctagttcatccttccgttaaaatggaatgtgtaaacagttttatctttacagatgttcgccggttttcaggtgtgcgacagcagcgggaatatcagccggtgctttgccggcaggctttccccaaggataaagagcgttgtatcatcctcatgatacggctgaatatcgtcggtttcaccatccgccggcgtgaatccgagcgccgctgtatgcagcccgggcggcaggagagccgaaaggatatcattgagcggccgttttgttttgccatatacgtcgtagcacagcaattcgccatccattggctctgcgacggccgccgccccgcagtcttcgatgaaaaagacctgccttttcagggattgcgcgcagtaaaacatgagcaaatccctgttatccagcatcgggaacgcggaataagggttgccttcggcatacagccgcaggaaaagcgcaagatcggcgctgtcgtccatatcaagcctgcggacctgtgtttcccgccgcacgattgtacgccgatgcatccattcttctgcggcagaaaaaccgaattttgggtaaaagccgcgcgcgttgtcgtttgcgaacaggtaaatggcatcgcattggccgcgccactgttgtagaaccaactccatcaaaaaccggcacaacccgcgctttcggtacgcggggtcggtcatcacggtaccaatctgaatataacgccgggcgcgcccttcaaagatggtatccatcaggttaacagagacattggacacggcgttttttccatcgaacaaggtataggggagatagcgcgccccccagtaaccgcccgaaaaccatggcgcaaagtctaggttgaagatttttcttgccaatgcaaaaaacgccgtgcgtgcagccgaatcgtcccgcacgttatgctccaaatggtatatttttccgttaattatacaattattcatgaaattcctccgccagatggtagttgaccgtttgccgtacgtttgcactgcacaataaaagccgttcgtccacaaagggacgaacggcagaacgccaatccgtggtaccacccaaattcccatacggcaagcccgcatggacactctcgcgcctgtaacggggcgtcccgtcgcggcctacaacgcacagcttcagccgcgccgctcgcgggcgaacttcgcgctttcggccatggtttgctttcagccggcggcaaacctctctgtgatggcgctgcaaagggctacttttcccgttctcagcgttttgattccttatataataactgtatgacggctattatagcatgccggcatttgttttgcaagcggttttgcgccgctttttaaaggatagcgtcgtcgtctccacagtcatcgcagccatcgtcgccatcgtcaacaatttcaccgacacgcatccggcgggcaatcttcatttcctccacttgtttgtggatcagctctttaacctcgcgtggtttcctgatatttttcagttccagctttggaaggcttttgtcggaggactgcaccaatacggttcccacacggaaaatacgctgccaaagcgaaatagacaggctgatatcgcgcacacggtaaaggataacctcctcctgcttcatattaagaagccctgtctccaaaaacagcctgtcgtccgacagagaatagcgggtaaacgtgatgggcataccgcagatacgtttgcggtcgtgccagagaatcgtgatgccttccataataaaaatcctccattccgccgcgaaatgcggcacaaacagaaataaaatgttcccccggcgaaatgggggatttttttcgccgtcattgccggttgccccaaaggggcgaggcaatgggcgcttgaaagacagtgtgaatattcacactgtcctccattccgccgcgaattgcggcacaaacagaaataaaatgttcccccggcgaaatgggggatttttttcgccgtcattgccggttgccccaaaggggcgaggcaatgagcgcttgaaagacagtgtgaaaattcacactgtctttcataataaagtaggcttttaaaaagaatagcatagaaattcatgcttgtaaagccgccgacagcttgatagggacgcgccggacggttataatataaaaaaatggaacagggaggcggccaggtggaacagatacagattgaagtttgctgtggttcggttgaggactgcaaaaaggcgcagcgcgccggtgcggacagaattgaattggtgcaggcgcatacgctcggcggattgacgccgtcagctggggaagtagcaatggccaagcgcgctgttgacattccggttatggcgatcatccggcctcgcatggctggtttttattacagcgaggacgattttgatgcgatgtgctttgacgcccggcatctgctggagcttggagcggatggaattgtgttcgggtttttgtcgccggacggttctcttgactatgagcggtgcgcgcggttcgtcgagcttgcgcgcggcaaacagacggtgtttcatcgcgctatcgatatcacacgcgatccttttaacgctgttgaacgcttggccagacttggcgtgacgcgcattttgacaagcggtttttcagcgggaagctacgacggccgcgcgcagatcggcgcgcttcagaagcaatttggcgatcgcatcgaaatcatggctggcggcgggattaccgagcagaatattgccgccctgattaaagagagcggtgtgcgccatgtacattttggcggtacggcgcgcttcgccgatccgtcctgctcctacaggccgggcattgcgttcggcgcgtctgagttgccgcccgacgactgctatatcgctgtcgacgagtcgcgcgtgcgcgctatggcgtccgcggcccggactatggcatagatccgaaaaaaactttccagcttttttaaaaaagcctcagtaaaatacttaactggctggacgttttatagaagaaggccgcccgcgttagcgggcggcctttataatttatttaacctgtccggttttacttcaatgctccttcaccgcccatcagccttgtcatttcctccaccttttccaaagggaaaggcggaagcacaacaggcttcatggccagcgacataagcttcatgggattatcatccgccgcaatacggtttgaacttaattttccgcaaatgcggcagcgatgaatcaccgcccattctccatgctttctgacccatacggcgattggttccatgacgccgccgcaatcagccatccggtcgcctggttcatcgtccagatgctggctgcataaacaattggggcaatggttccgatgtgaactgccagccccggctgggactaccgttctcccgcaaaccttacacacaaagctgtcatgacatgcatgtgttttaaaataccctttttcaaatgattttttcttattttctcgtttcattatgaaacatcctccaaaaagcaaaatggtacttttgggaggtttgagcctggattgtcttacgcaaacctcccggttagcagacaatcaccgatgcacagttatttttcatatacgcgctcctaaaaaatataataacaagtctggccggcgaaccgattggattcgaagccaaacatatttataattattctatcatacattcaaccttttgtctacagaaaactgtatggcggccagaacgcggtaaatcagttggctaaagcgaaagtgacatcaacgcggccaggcgggctgccgaaagatcggaagtgaccctaccaaaatattttccgcctgggatttcactgaaacctgatattagggatggcgcacaaacaagatcagcgcaatatgttgttgtgcgcccacattgctttgtataattttttcaatggtttatcggataattcataaccggcgcgtttgagcaatgtaaacatgatttcatacccagccagataataatattcccaggaatcctcaatggcgcgtttttttcttgcaaactggctgttgaattccgcgtgatcttctggcggaaactcgttgatatacgaccggcaagtctgttccaacgcctgttccaaatctgccaggccggggatctgtttcaaaccggccggcttcacgacctgtccaagcaggccgccagccgcgccgagaaagccttgtgcaaaataatagttgctgataagttggtcataatcgataaaagcgtcaacaacgacaggatagctgttgtgcgactcaaattttgggagaaaggaaggatagtacctcataaactcccgatagctggaggagaacagttgttggtagggtatcatggcggtggaaatctcccccatcatgccttctataaattcttctgtgaccatatgcttttgagacattgcgaatcctcctttttgttttatggaaatcggcaaaagggagatttttcatatgccgtcgattaaatgcaatatataaaaacagccccggaaaaatcggagccgcctttacttgaaaattgacgatgacaagcttataatagaaaaaggtacggttaccctggacgggcggcccagccttgtgttattataggagcaggtatcgccgcactttagcagggcggggcgatacctgcgtatcacaaaacaaagagcgcctgtggccagccgtatgggaaacgcgatctttccagaaaggttcgcacggtcagcggatataggcaggtctttggtttgcgcaattggagcgtgataaagatggctgataagcaccctgccaaccagccggaggagacgaccgttctttatcaaaatataaaggctatctgtgacgagcagagaaagagtatttctcaattagaaagagattccggcattcctgcaaaaacgattgctaattggaaggcgaatcgttcttggatgattgcgcttattcgtgttgcagatacactggaaatatccttagataaactatttgatcgccagagtatatcagaaggcgataaccatatatcagagattatgtattcactcaaggatcttcgattgaatgaaaaaagtacagccgctattatcaagatagcaaaaataatcgcattaagtatgactgaacccgaagattagcgtactatttaacgtctataatcatattatagcggtaaaaatactccaagtcaagacaaatatactccaaaaagagtatatttgtcaaattgaggaggtcgtatgaatcagctttatgaaagaatagtgttgttttcgaaatccaatcaaatatctttatatgcaatagaaaagggtacaggaatggctcgtgggtcattacgtaaatgggcaacctctatgccttcaggcgatagaatattgcgtgtcgctaattttttagatgtatctgtcgattacctcttgggaaataccaataatccacaatctcacaaaaatccagaaaatttaagggatgctttaatgcaggtgactgaaatttataaacaggcaaatgctaccgcagacaaaattctcgcatcccaaaatttaatttttttacctaacaacacagatcctgacgaaccgtaaaagccgctgtttgcatttgcaaacagcggctttctacaatttgacaaaatatgtaatttcctgctaaaataatattggtgaagtgaatggattttatatggatttaaattttataataagacgtctaaccgaattgcgattaaaaagagagagatttcagaagcgcaaatgagttacgagcttggtcacacaaaaagttacattaatggaatagtatctggaaaggctcgtcctaccgttgagggattgctagaaatcatagaatatttaggcatctcaccttctgaattttttgaggtcaactcaaacgatcctgatgtagtaaccgcgataactaaacgggcaagggagctatcaagagaagatgccctagtcttattagaagtagcaaaccggatgaacgggaaaagtgatagcaaatagcttttttcattatagcaaaagaaaatcgcatcgtcaatgatgtgattttcttttgttataatactattcttagaatgatattatacgctaaaaagttttattaaagatggttaatcgcggcgtatttattggatacaatgaataagggtgagcaataatgagagcatttgacagattctttcatcttgagccaaaatataaccggtcgtatgaaattattgatatattttatgaccagcttgtctatctttctacccatgttttggatgcttctctaaataagctggtgtcggcagcagtatatcatttaattgaaaccaaaaagattacaatatatcgtgttgaaaatagcaatcattcaaaacgttcttttgcttttaaggaaagcttgattaatggattggagtccttgagcaaagaatacgatcttcctgttggaaagttagtgaatattgcaatttatgtagctttagacgaatactcagaatatttaaatcgtgtaacctattggcgttcggagtaaaaatgataaaatatgataaattatggaaaataatgaaagaaaagggtatttctcaatacgctttatatacaacttacaatattaaccgttcacaacttaatcgcttacgtcataatgaaaatgttcaagttaatacaattgataagttatgcaatattttacattgtcgagtagaggatataatggaacattttgatgatgataatacattttgatcctgttttgaatggatgtgtcaatatggatgtagcttctcgatattcaaacgatgaagctcgctttttaaaaaatattgggttccgcattcagttctttcgtaagaaatgtggaatgagtcaagaagaacttgcggaaaaaagcaatttgagctattcaacgataagtcacattgaatccacttctacctatcccatgtctattatagctctctatcgtattgccgctgctttaaatatcgcgccttatcagcttctaatgtttgattgatgttcatggtactgctgcacacctgaaatggcaacagccgccgttcatattttatgaacggcggctgtttatatgttataaattacaactcccccttatttgttttatggaaatcggcaaaagggagatttttcgtatgccgtcgattaaatgcaatatataaaaacagccccggaaaaatcggagccgcctttccttgaaaattgacgataacaagcttataatagaaaaaggtatggttaccctggacgggcgtcccagccttgtgttattataggagcaggtatcgccacactttagcggggcggggcgatacctgcgtatcacaaaacaaagaacgcctgtggccggccgtatgggaaacgcgatctttccagaaaggttcgcacggtcagcggatataggcaggtctttggtttgcgcaaattggagcgtgataaagatggctgataagcaccctgccaaccagccggaggagacgaccgttctttatcaaaatataaaggctatctgtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgataaagatggctgataagcaccctgccaaccagccggaggagacgaccgttctttatcaaaatataaaggctatctgtgatgaacgtaatataagcattgctaaaattgcgaaaaatgcgggggtttctgaaagcacaatcgcaaattggaaaaaagaacgtagctggatgagaagccttccagcggtgtcaaagtcattgggaatcagcatcgattctttatttaatgctaattgtaatgagacttttgtgaatcaaatcatgcatattctggaaggagttacccttgacgaaaaatccacaaaaattattattaaactaattttagcaataactgaataaatcatgggtgatagataagtaattataaagccttatattaccatgattttattatattatacagccgtacacggcaaatgtcaactacatacaaactatttattgttatatatggtggaattatgagcgttttatttgacaggctttccctctactgttcacagatcgggttatcattctatgcaatagaaaatgcaacagggcttacagtagggtccttgcggaagtggaaagactcgatgccatcaggggacaaaattcttaaagtttctaattttctaggagtttccatggattatcttatgggtaataccgataatcctgaatctcaaaaaaataatccgcaagatttagttgccgctgcggaagaaattgcagctgttataaacgaatttcaaatgcaaacccaagatctaataattaagctaaataaaattttggacaaataccatattgattctactatcctcgcccagacaagcactcagccagaaaaagattaaatccgtttctgaacaataagagccgctgtttgcaaatgcaaacggcggctttctataatttgacaaaatatatcattgcctgctaaaataaagtcggcgttgcaacaacggcaggcggttggccacaccacccgaaagggggtgaggctgtgccaattaccataacgttacatatcctcggatacaccgtaacgatacggataaaaggcagaaaccgccactcggccaagtgacggtttctggggcatatgctctgtaacccatactagtcggaccaaccgcttgtcgcagcgccttttatgtttttattataccgctatgtagccgttttgtcaaaccatcaaattgacaactattcacagaagctgtaaaataaaaccggcgctgcaacaacggcaggcggttggccacaccacccgaaagggggtgaggctgtgccaattaccataacgttacatatccttggatacaccgtaacgatacggataaaaggcagaaaccgccaccccggcaggtgacggtttctttagctttgctaaattaactgtatcgggccaaccgcttgtcgcagcgccttttatgtttttattataccgctatatagccgttttgtcaaaccatcaaattgacaactatccacagaagctgtaaaataaaaccggcgctgcaacaacggcaggcggttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtcaaaccatcaaattgacaactatccacagaagctgtaaaataaaaccggcgctgcaacaacggcaggcggttgaccacaccacccgaaagggggtggggctgtgccaattaccataacgttacatatcctcggatataccgtaacgatacggataaaaggcagaaaccgccactcggccaagtgacggtttctaggtcttgaaaacttagaaattttttcctgggccaaccgcttgtcgcagcgccctttatatttctattatatcccacagccgtacagatgtcaagaaatatgctgtcttgtggctgcggtgtgacatatagcgcagagcaaacagccttgctgtttgctctgcgcatattataatatcatcaacattgttccggccgtaaccaatagcgcgccggcgatcgccttgggggaaattgcctcatgcagcaggaaaaatgcaagcgcgacagtaataacgagactgaatttatcgatgggaacaacctttgcaacgtcgccaagctgaatggcgcgataataacagagccatgacgcgccggtggctaaaccggacaggatcaaaaataacaggcttctgcgggagatggaggccaaaccgcgctgtgcgccggtggcgaatacaattccccaggaaaagatgagtacaacgaaagtgcgtactgccgtcgcaaggtttgaatcgattttttcaacacctattttcgccaggacggaggtcagcgcggcaaacacggcggagccaactgcaaatacggcccacatggaaccgcctcctttaaaatggacaggttataaacctatgtaggaaaaccgcctttagctgtccgcgcacgctctttggagtagccgtaaagggcgtttggaaaatgttcgcgcagcgcgccgatcacttcgcgggtttcgcagtgggagagtccgcgtatgctggcagaataatggacgccgctgcggtcgtaaaagtggacggcagcgttcgtgccgatttggacgctcagggcaaccgggttctctgaaaccgggatgccattcaatgtgagatagacccatgcggcctcgccatagctgagaaagcacggcatattggaattctgcaaagtgaaataaatgcgccgcgcgccatacaggagcataccattctgaagcgaagcggcctcctgttcaatttccatacgatccgaattggcgagcatacgatagcgttccagggttgcctttcgggaacggcggccgacaaaaaagaaaaggatgccgattgtcagcagaacaccaaatgccaccatgaacagaaaaagtgcgacgattgaaaccgtttggatcaggtagccaaatggcatgctcccaaaagcgcctgtctcaaagactgaaaaggtcaggaaaaccataaccagacaggccgccgagattgccagaagcagcagcggccggcgcgaccggcgcatcagacgtttgtaaaactggaatgacatgatttattccgcctttccaagcgtccccagactcgcggccttgaggtaagcgttgataaagccgtcgagatctccgtccataacggcgttaatattgccgctttcaaatccagtgcggtgatctttagcgagcgtatacggcatgaaaacataggaacggatctgcgatccccaggcgatctgcatctgttcgcccttgatctcattgatgttggccaggtgctcgcgttccttgatttctacaagctttgccgtgagcattttcatacacatctcgcggttttgaaactggctgcgttcattttgacacgagacgacgatcccggtcgggatatgcgtcaggcgcacggccgatgaggttttgttgatgtgctgcccgccggctccggaggagcggaacacatccatcttgatgtcctcgggattgatttcaacggagtgatcgtcgggcagctccggcagcacctcgaccgaagcgaacgacgtgtgccggcggccggacgcgtcgaacggagagacacgcacaagacggtgcacgccggcctcggaccgcagaaagccgtaagcattgtctccggtaatcaggatcgaggcgcttttaagccctgcctcgtcgccgtcgagatagtccagaattttatacgtaaagccgtggcgctcggcccagcgcgtatacatgcggtagagcatctgcgcccaatcctgcgcctcggtaccgcccgcgcccgcgtggaaggtcataatggcgttgttcgcgtcgtattcaccggttaacagcgtggagagcttctgcgtttcaagatcggactcaaacctttccacgtcggccagcgcctcggaatagacggattcgtcgttttcctcgtccgccagcccgatgagcgtgagcgtatcgtcgtaaagggcgtttagcttgtcgcaggcctccagcttgcctctgacgcgcgccgtttcaagctggtttttctgcgaacgctctacatcgttccagaatccgggagccgtcgtctgctcctccagctcggcgagctttctgcgcagagcatcatatccgatcgcctgcgcaaattcgtcaagctccgcgcgatgcgcttccaggcgcaaacgcagttcctcaaattgcagcatataataggttccatcctttctgaggtgtgtggtgcgtgccggacgggcgcagtccgcaaaccgaaaagcaggcacatattgtcagcatatattatagtattttttcccgtttaagtaaagataatcttaaattcaggatgcggattcatatgctccatactgcgtttaaaagcggcagatcagcgtatttacacgaaaaattcataattatgcccttgaattccgtcaggtttctttgtatgataacacattagaagtaatgcgggaccgcgcgggtcccaaaggatcaggggttgatttcttggcaaattatacaggcgcgcgctgccctgtgtgcaataagcggttcacggacaacgacgacattgtcgtctgtccggtctgcggcgcgccgcaccatcgtgaatgctacagcaggttgggacattgcgccctggcggagctgcatatcgacggacatacctggcagccccccgaacgcgaggagaacgcccaggagccggatgcggctgtctgcccggcatgcggcgcgaaaaatccggcgacgggaatcttctgccagaagtgcggcgcgcccttaagccggcagtctgcgccggattttggcgggcaggctccgtttggacagacgccctttggtgcgcaggcgccgttcggccggccgggcggtccgcaggcgaatccgtatacgtccgcgtttggcggcctggacccggcagaggaaatcgaaggcgtctcagcgcgcgatatcgcgctgtatgtcggcgaaaattcccagtattttttgcccaggtttaagcagatcgccggacgcagcggctttaccatcaatttctgcgcgctgttttttaacttcttttattttttttaccgcaagatgtacggcatcggcgccattttgctcggccttttggcggcttcacagatcccgacgctgtttgttttgccggaaacaatccggtttgttctttcgcatatggaggatattctcaacggctttaacgtgtttaatctgtttgcgccgacagagcacctgtgggcgtacagtgcgatgtactatatgcgctttgtgttgctggctgcggggattgtattcgcatgctttgccaaccggctgtacatgcgccacgtgctgaaaaatgtgcgcaaaatccatgcgcgttacgagcagtcgcccggcgggttcaacgacaaccgctacacacaggcactggcgcattacggcaggaccaaccgcgccattgtcgtaattgcagcggttggatgtgtggtcgtatactttggcgtctacatggtcatgatgatggcgatgatgcaataaataaggcccgccgtccgcgtgcgcggcgacgggccttttgtttggagggttcagtatgaaagttcgcaaggccgttattcccgccgccggattgggtacgcgtgtgctgcccgcatccaaggccgttcccaaggagatgcttccgattgtggacaagcccgctatccaatatatcgtggaggaggctgtcgcaagcgggatcgaggatatcctgattattaccaaccgcggcaaatcgctgattgaggatcatttcgatcatgcgccggaactggaggaaaagcttctttcctccggcaagcaggatttgtacgacgaggtggtcgccttggcgcgtctgtgcaacatccagtatgtccgccagaaggagacgcgcggcctggggcatgcggtctggtgcgcgaagtcctttgtcggcaacgagccgttcgcagtgctgtacggagacgacgttattatttccgacaagcccgcggtcggccaactgatcggcgtgcatgaggagtttgggaagggcgttgtcggtatcaagcaggtagcgcgggagctgctgcccagctactgtacgcttggcgttaacgcggtgcgcggcaatatttacgatgtgttcgacatgattgaaaagccgatgccggaggagattatttccaacttcgccattcttgggcgctgcgtgctgacgccggatatttttgatatcctcgagcacacgccgccttcccgcaacggtgaggtgcagttgaccgacgcgatgcgtaccattgcgcgccatggcggcatgatgggcattgaatatgagggtacccgttatgatatgggcagcaagcttggcatcctgcaggcgattgtcgaagtcggcctgagccatcccgatattgggggcggttttcgctcatatctgcgggagattgcgcgaaccctgtgaaccgcgcaaaacagcttggtaaagcgaaaaagggcggcctgctccggcaggccgcccttttcagttttctctcctctcacactgttacgcgaacctcgtcaagatgatcgaccgaaatatccaattcatcgagaaggtactcacaaagctcgttatacagggaatcgtccggaagatcgccttcgacatagcgtgactcggctttgcggatgactgagacaagatgattgatttcgtcgaggtattcattgaagatacggtaataacgctgcttgctgttcatgatgtactgctcctctttgaatcgtcattcaaatggatgacgtatacgtatataatacgctccatttgctagactgtcaatgtaaacttatcgttacgaggtcgtgcaaatggagctgaactattacaggcgcctgcgcgaattgcgggaggatcatgactattcgcaggccgatatcggaaagcggttgggtatgtccaagcaacagtattttctgtatgaaaagggataccgggatataccaacgccagtgctgatcgcgcttgcggatctgtatgggacaagcgtggattacctggtgggacgcacggacaatccatcgcccccacagcgatgaggcgcccttgaaggcttataaccgaatggttattattaaaataattatacgtcttccttgataaactgtcaatagaactgaacagttggattgggaggcgaacaatgacgtcaaattattacagaaggctgtatgatttgcgcatcgaccatgacctgacacagaaagatgtgagcacatatcttggaatgagccagccgcagtattaccgctatgaacgcgggtaccgcgacattccgacgcatgtcctgatcgcgcttgcaaagctttatgacacaagcgtcgactatattcttggcctcacggatgatccacaaccccacagggaacatccgggtatataatccatacgttggggctgatggcaaagccgcctccccaaagcattgtcttggctttttgcggcgctttgtttgtcagcagctacgcatccgtcacgagggacgccgtgttttttcgcggcgtccctcgcgctgtcgggcgattgcagttcggctgtataaatccggcctgcggctgccaacaataaggaaagcgattttgcaggaaagcgaggagttgccgtttgttgggcagacgagctgctgggatttatattgttttggtgctgatttttacaggcatgctttgccgtatgtatgcgctttcaatgggggagacgctttcgtctgcggccaatacgcagagcgcgtttgtactcggcgtggacgacacgcgcgggattatctacgattgcaagctacgtccgcttgttggcgaaaagacgcatctggtagccgcgatacagccgtcgcccgaggcgtttaccgcgctgacggaagcgcgtgaaaaagggcttgacgcgccgttgcccgacgaggggcagaccaagccgtatctgatggagcttgacggccatgaagtttattcacgcggtgttgaaatgtttgaggcggtacagcggtatgcggacgaccaactcgcgccgcatatcatcggttatctcaatccggaaaagacaagcggcgtcgccggcatagaaatggcgtatgacgatttgctgcgccaatacgacggcagcctcaagctgcgctatacgctcgacgcggcgggcaggtcgctttcgctcggcgcgccggagatcgtgcaggacaactataaaagcgaaggcggcgtggcgctcacaattgacgcggatatccagcgcgcggcgcagcgggcgatgaaggacgtcaaaaagggggcggctgttgtgatggacgtcgaaacgggcgacatcaaggcgtctgtctccatgcccgcctatgatgccaacaaccttgcggacagcctgcacaatccggacggaccgtttgtcaaccgggcgttttcgcagtacagcgtcggttccacctttaagcttgtcgtggctgccgccgctttggagagcggctacggccgctatacgccgtatacctgcaagggctatgaagatgtcgacggccatatattttattgccactggcgcaacgggcacggtgaaatcgatttgcagaaggccatcgaggtgtcctgcaacccgtttttcatcgatctcgggctgcgcgtgggcggaaagcgcatcgcgtcgatggcgcgtgaaatcggcttttcgcgtgcggcccagtttacagacgatatcaaaacgcaaagcggaacgctgccggatgacgcggagctgtcgcttgatacggccgtggccaacttttcgtttggccagggttccctgaccgccacgccgatccaggtggcgcagatgatctgcaccgtcgcaaacggcggttatgctgtgacgccgcgtttggtggagggattcaccgacgatggaaagacctattacgagcatacggccgcatacgcgccgagtcaggtgttttccaagcgaacttccgatatcctgcgcgaatgtctcgtttcaaacgttgaggagggcagcggcgtaaaggcaaagccctcgtttggaacagccggcggcaaaacggcctcggcgcagaccggcgtttatgaaacgccgggcgaggaggacagcgagatcgtacacgcatggtttgccggttattttccggctgagacgcccaaatatgcgatcgttgtgctggtggagggcggcgagtccggttccgacacggccgcgccgatctttaaggagattgcagacgaaatcctgctgcgcgagatgtaacccgcttgtaatcgcgcggcaaaagcggtataataaccggtgataccggttcatagttccgacaactccagacgcggggcgcgtttggatgacaacctgtgaggggatacgctgtatgagtgcatatatcattgtgaccgattcaaatgccgatctggtgccgggatttgcggctgaaaatcagattttggagcttgagcttacgtatacgatcgacggcagcacctatcgctgcaacgatcccgcgctttcccggcacgcgttttatgatatgatgcgcgcagggaagatgccgatcacggcgcaggtcaatgtcgaggaggcgcgcgcgcagcttgaggagcagctcaaacacggcaacgacctattatgcatcatgttttcctccgcgctttccggtacgtataacagcgtgcgcgtcgccgcacaggagcttgaggccaagtatccggagcgccgcgtcgtcgtgatcgattcgctctccgcgtccgcggggcaggggatgctggtcgcgcgcgccgtcgattacagggagcagggcctgccgcttgaggagaatgcggcgcgcatacgtgaggatatcccgcaccaggcgcatctgttcacggtcgacgacctcaatcatctgcgccggggcggacgcgtttccgcggcgacggcgcttgttggcaccatgctgggcatcaaaccggtgctgcatgtggacgacgagggccggctgatcccgacaggcaaggtgcgcgggcgcaggcagtcgctgcttgcgctcgtcgagggaatggcgcgccagatggaccgcgcacggtgcggccgtttcgccatcagccacggcgactgtattgaggacgcgcagtttgtggctgacgaggtgtgcaaacgctttgggctgcgcgactacagcatcagctatgtcggcccgacgatcggcgcgcattccggcccggggacggtcgcgctgtttttctatgcaaagcagcggtgacgctttaccgcatctgtatgcggcccgtacacggatgcggcctggtgaaaaacagttgaaatttgcaattgcgtatggtataatctgtgagtatctgaaataagagcatgaccggtgtgtgcccagacatgcgggtatgcgggtcctgtgcgacagagcgccgtgaaccatgtcaggcggggaaccgagcagcattaagcggtttgtgatgtgcgccgcaggtaatctgcatgcccgcatatgtgggcacacacttttagaacctgtatttacagccggggaatgctggacagacgagggattttgcacccggtcaaggcaaattttcgcaggcgggctgccgcccggcaagaaaatttaacgcaaagcgggtgcaaaatccccgtccagacagcgttaaacggctgtgaatacaggttcttattgccggcagggaggtgaaaacgatgtatcaggcgctttaccgcaagtggcggccgaaaacgttcgacgacgtggtcgggcaggagcatattaccgccacgctgaaaaacgaggtggccacgggaaagttttcgcatgcatacctgtttaccggttcacgcgggaccggcaagacgacctgttcgaaaattgttgcaaaggcggtcaactgcgagcggcccgtcgacggcaacccgtgcaacgaatgcgccgcctgccgcggcattgacgacggttcggtgctcgacgtggtggagatcgacgccgcgagcaacaacggcgtcgacaacatccgccagctccgtgaggaggcgtattttctcccttccgtcgtcaaataccgcgtatatattctcgacgaatgccacatgctttcacagggcgcggtcaacgccctgctgaaaatcctggaggaaccgccggagcacgtcgtgtttatcctggctaccacggaaatccacaaggtgctgccgaccatcctttcgcgctgccagcggttcgatttccaccgcatccgttcgcgcgtcatcgcggacagacttctttatatcgcggaacaggagtcgttttcccttgcggacgacgcggcgcttctgatcgcgcgcctgtcggacgggggtatgcgcgacgcgctttctctgctcgatctgtgcgcttcgtttggaacagacatcaccgtgcaggcggtgacgcaggcagccggcctggccgggcagtcgcatctgtttgaaatcgccgatgcggcgatcgcgcgcgacccggcggcggcgcttttggtcgtcgggcgcctgagcgaacagtcgtgcgatttttcgcgtttgtgcgaacagatgatcggccattaccgcaatttgatgattgtcaaaacggttcgtgaggcggacgatcttgtgcagggcacgccggaagatttggagcgtctgcgcacgcaggctggcggtatttcgctcggtgcgatcatgtatgcgctcggcgttttgcaggacgccgcgacgagcctgacgcgcacggcgtttaaacgcacggagctggagatggcgattgtccgcctgtgcgacgagcgcatgggcggcggcttggagggcgtgctggaccgtctggaaaagctggagaaggcggcgcgtcttggcgccgcacaggcgccggccgcgccgccagcgcagccggaagcgtccggggcggcaacggcgccgccaaaggacagtgcgaagccggtatccgccgcagccgcttcgaagccgaaaccggcggccggcgtggcacaggtgacgccgttcggcgattgggcgcgcgtattggaggagcttgcaaagatcaatgcggctttgcgcggcgcgatgaacgattcacgggcgtttgtgcatggcgaaatgatgctgatcgactgccaaaatgagctgttccgcacgcttttgcgcaccagcatcgccgcgaaggagagcctgcgcgacgcgattttggcagtcacagggcataaatataaccttggaccgtataaccccgacaagtacgcgcctgccgccgcgccgtcagacccgctggaagggatgctcaaaagggcgagcgagctggacgtgcctgtcgaactgaaataaaaaggcccgcgaaaacgggaccgcttttgttggaggaatgaatcagatgaaagcaagattgccgcagggaatgggcgggggaccgcagaatatgaacgctatgatccgccaggcgcagaaaatgcaggaggacatgaaggcaaagcaggaggagcttgagcagctcacgtttaagacgacgtccggcggcggcatggtcgaggtgacgatcagcggcaaaaaggaggtccagtcgatcgtcctcaagcccgaaatcgtcgatccggaggacatcgaaatgcttcaggatttgattgtcgcggctgtcaatgaggcgatccgcacagtcgaggagacaacaaacgccgagatggagaagatcaccggaagccttcagattcccggtatgatgtaacgtgtgatggcgtatcatgtagtaccgcttgtaaagctgatcgaacagtttgagagactgccgggcattgggcgcaaatcggcgcagcgtctcgcgttttatgtgcttaatctgccgcgggacaaggcgcagcagtttgccgacgcaattgttgaggcgcatgataaaattaaaaagtgcagcatttgtcaaagcctgaccgaaacggaagtttgtccaatctgttcggatcagtcacgcgacgcttccacaatctgcgttgtggaaaattcgcaggatgtgctcgcatttgagcgcacgcgggagtataaggggctgtaccatgtgctgcacggcctgatttcgccgatggacggtatcgggccggaacagcttcatatcaaggagctgcttgcgcgtatttccgccggcggcgtcgacgaggtcatcatggcgacaaatccgaccgttgaaggcgaggcgaccgcgatgtatattgcgcgcctgctcaagccgatgggcgtgcgcgtgacgcgtctggcgtatggaattccagtcggcggcaacttggagtacgccgatgaagtgacgctgttccgcgcgcttgaggggcgaagcgagctttgattacatagggttcgtacctgtgccgcccatgcgggcggtttttcacagaaaggatggggcgttttatcaaacgccggacaatagatgtttcaatttggtgattccggacgtgaggagcttaagcgcgcgctcaaattcgcagtaaccggcgtcggcaacaccgtggtcgactttgttgtttttaccgtgttggccgtgtggctcggcgccaatgttccgttttcacaattctgcggatattctgcggggatgctcaacagctatctgatcaaccgaagctggacctttcaaacaaaggatcgttttttcagcctgcaaatggcgcgttttgtagcggccaatgtggcggttatgcttttaagcatggtcctgattcaggcgggaatcgcttatcttggaatgagcaaactcgtggcgaagctgtttacaacagcgtttacaatcgtggttaattttttaatcagccggttgtgggtattccgaaagtagattctatggaaagggggaaacgtctgtggaaagggtatctaccaaaacgatttcggtcaataaaaaagcgcgtcacgactacttcgtggaggaaagctttgaagctgggatcgagttgtttggaacggaagtgaagtcgctgcgcaaaaatgcatgcaacctcaaggacagttggtgcgatatcaccggcggggaactttttatcaagcagatgcatatttccccatatgaacagggcaatatttttaacaaggacccataccgtccgcggcggcttttgatgcatcgccgtgaaatcaataagcttatgggtctgattgcacagcaggggtatacattgatcccgttatccctttattttaaagggtcgcgtgtcaaggtgcagcttggattgtgcaagggtaaaaagctttatgacaagcgcgacgacatggcgcgccgcgcggcacagcgcgatattgaccgtgcattgcgggatagacaaaaggcataaagacgtgtataatacgaatgggagaaactgctcccttactatggggatgtaaaggtttcgacggggatctcgaagtccaggtagcgggtagaggagcatgcacctctataaaagtatgacgtttttaaattagacgacaacgataatttagcttttgcggcttaattaagccgccgttccgctgcggagtaccacggccgcggacggagcgtcgatgagtggtgaacgatcggtccaagcgcctcgtaggacatgattgtattgggggctaccaaactgcatagcctgtcggacggcgatgcagcgcgggaagtttaaaagaccgactgcacccggagaagcttgggtggactggttttcggacaggggttcgattcccctcatctccaccacgtaaagccgcttgcaggtttattgcaggcggctttactttttacgataacacactttataacacgtttttatttaacagctttgcaaacaaatcgccgatggcggcggcagtttgctcggaatcattgagcagcgcgtgcccgtattgcccaaaggtgtccatgctccgggaatgcccgacaagcgattttatggttccttccggcaggtactttgcaatggagacaaatgtatgacgcagttcatatggcgatatagcgggcaacccattagattcaagataccgtttccatcttttataatatgcgccttgacttttgatctggaatagcggcgtttccgcaagcagcggttctcctgtatctttaagcagtttgatctgcccctcgattgcctgttgggctaaaggtgatggggtggaactgcggattgcattctgatttttaccttgtatgactttttttatgtggtttatagaccgtttaatgcatatgtcgccggtattggttatgtcaccgatctggaggccaaccagctcgcccggccggacgccgctggccacttgaaacctgtatgcgtaaatataattatcaaagacgcgctgtccgcgcatgatcgttgtatcagtgcggaataacactgcaaggctatccggctgttaaatttttccgcgatagcgggcgccctctggtatcgtaacatcttccggccgcagagaagttgtcttttgtaagcggcaccatttaataaacgccaggagcacggcctggatgttgagcagcgtttttcgggataaaggaagctgctgcggccggcgctgtttataatcgactttatatgaaccgtgtttataggcggaatcgataatcccttgtaaaacaccttcggttactttctcaattttatgacgccccatgattggcaggatataattttcgccgactgatacgatttgtagatatgatgaccgggattgtgtatcccgacattttttcaggtataattgccacaggtcggcaaccttaacagaaccgctgatgccttcatccagccaggcgtccgccttgcggttgcattctcgctggccgttgcgcccgggagtggagcaagtaaaagtccgccgttgcccgcccttttgaacgttgatctgccaacgcttttgcgagtccagccattttgctgtgttcgtgtgtctgcccataaaaaacaacacccttccaagcccttgcgcgcggcctgaaaaggcggtataatagacacgcagagcttataaatttttggtaggtttatatgcttgcacccatccgttcccggttgccgccggggacggatttttttatgtttagttatatttatgactaggagcttccgccattagatatttgttcctcaagttcggccatttcagaatttatcttttcggatatttcttcttgtgtatagcctgcacgaacaagcaaggttcctctattagatgcaatcagtagggcggcttccttagcatcttcaaggtgatcagtagttttggaaagatcggatatgttacctttgtctaagtatttcattatgctttccgtagccatttgatctgataacgccatagatgaaaaagaagataaataagttttttcttcgctattgtttccataatcaaaactcatagcagctttcctaaaatattcttttgcttgtttcattgaatcatacaactctaactggcttacgcgcccctctgaaaaaagggaaacattttgtaaaagtctactatgtgacacatataaatttttaaaatcagcccatgtacggtcatcaaattcacgccaagattcagcgctggttgatgttgtgttagaggatgtagcattgtttgagttctctgtaatttttgtgacaacacttattataccagttatgacaaagagtacaatcaggacagaaattaagcaacccttccctgtttttttaggcttttcgggcaacggctgtagaccttgattttgaggagacgaagcgctgttggtactttcagttggtgtattattcagtaggcggcttttctgttgatcgtattcatcttgcgtaagaataccatcatcaagcagcttttttaatttcgctatttcatcagtaattccaatagaagtttctgatcctgtgattttgtcatccattttcatgtctcctctcatgttgcctggatgaaaattccttttaaagaaatataatacaagtattacaatagacttaccggaataaaatggggcgcccccgatacggaaaaggagaaagactatgcgacggtattgaaaaagtagttccccttgaaaacattcgggagaaaatccaagctcttttagagttagcggatgacaggcagctaaaaccgctggcgtgaatgcgcccctggaattcaccactatatcacaagggaagaagccgtcaagcatgaaaattaggagacaactcggtgaagcgggggaagcgaggtggcgggaaatgcctaaaatgacaattcgcgttattttgaagaacggttcagaattcgcgatcaagtgcgataagttcacaattacgaaaaacgacgacggacaggcgaccggatacgatattgaagggattacggaaaacaagcccgtttatttagactttgaacaggttgcggcggttgtccgcgtttattccgatgaacatacagaagattcgccggaagctgaaaagaagcagaaattcaccgaaacaaagacaaaatgcccgcattgcggcggcgttgaaaacgcggttatatacgccgacgaaaaaaacaaggaatatttcgtatattgtctgatatgcgggattgaaacggtggaaacatacacaagcaaggcgaaggcgttaaaagcgttcgcggacgggaaaacaaaaccgatttccggaaaggcggctggcggcggtgaatagtgcgcttctatcttcaaagaaaatggactattgcacaccacaagactttttcgacgaacttaaccaggaatttcattttacccttgacgcggcggcgaccgcaaaaagcgcaaaatgtccgaaatattacaccccggaaaccgatggactaaaaagcccgtggagcatagcgggcggaggcgctgtattctgtaatcccccatacgggcggaaaatcggaaagtgggtgcgcaaagcttacgaagaatctcggaacgggacaacggttgtcctgctgattccggcccgaacagacacggcctattttcacgattacatatacggatgcgcggaaattcgctttgtgcgcggacggctgcatttcacagatgaggacggcaacacatacgatcgcgccccattcccctctatggcagtcatctacaacgggaataaggaggtttcgacgtgaaagcatttaccgtatatcagccctacgcattcgcaatcgtggccgggttgaagcattatgaaacacgcccccggcggacgaacattcggggccgcgtagcggttcacgctggaaaactcgacatgatacaagtgacaaagcggatttcagatcgaacattatgggacctgatggaagcggtttccgggaaaacagagttgccccgcggcgcggtggttggaaccgtggaaatcgtcgattgcgtcccggtggaaaacattatggacagtttggacgaacgggaactgcttttgggcgactattcgccggggcggttcgcgtggatactcaaaaacccggccatgttcgacacgccgatttcggcctgcggtcaacagggctggtgggaatggcctttcgtttgaggagcggataggatgacgcatttatcactgtttaccggtatcggcgggcttgatctggcagcggaatgggcgggctttgaaacggtcggccaatgcgagtgggcggattacccgacaaaagtacttgaaaaacactggccggatgtgccgcgctggcgggatatccgaagcctgacaaaggagagtttccatgaacggacaggactgcggacagttgacgttatttccggaggattcccgtgccagcctttttccgtcgccgggagacacagagggctgggtactcgttggaacataccgcgacagcggcaggccgtagcattcttggaggtgagcggtcatgattgagtacgacaagctccgcgaggagcttgaggaggaaaaggcggcctgccagtacgcatacggcgagatggttgcggcgttctacacgtaggcactccgcaaggccatcaaggacatcaaggagtgccgcgactgttcagcagaggcgtggcaaatggcgagggagatgaaatgaatggacgaatataaagtgaaacaactaaggaaaatgcttctccatgaaacgagcgagaacaaggagcattacggggcgcggttgagccattggtacggagacaccaacacgcttactatcgacgcgggcggactgtaagcccttattcgctactacgagacacacgacacagatttggagggaacagagcatggatgaaagaacctatttcaccatcaacgagagcagcgcgagaacggcgcacaatatgatgtcattcagggactacgcagacggcagtaccacggcggaataccgcagggcggcagaccgggcctatgacttagccgaccgggtagccgcagggagcccggaggaggcagagagggcttacaggctggcggctcgatatgcgaaaaagatggcagattactacaaccgggaggccagtattggcatgatgtgcccgtcggttatgatttccggcgcaggcaatttcccggtcaggaagaatgagaaacaagtagctgcatgggagagaaattaccagttctacgaggacacgcagaaaatcctcagcaagatagagagcattctcaacggcaggggtattatcaagtcggacgacgagagagctgtcgaaaagctggaagaaaaactggaggatatgaaaaccttgcatgagcagatgaaagccgtaaaccgcgctatccggctcaaggacacggaagcgggcaacgacgcgctgcgggaaatgggctacagcgaggaggccatcaaggagcttcgtataccggacctcagtggcaggattggctacccggaatacgcgctctcaaacaacaatgccaatatccgccggttagaggagcgcattaagggattgaaagcaatcaaggagaggggcggctctgagcaggaatacaagacatttaaggtcgtagagaacacggaggctatgcgctatcaaatcatcttcgacggaaagccggagccggaagtccgcgacctgctgaaaggcaatggcttcagatgggcaccgtcgcagggtgcgtggcagcggcagatcacctcgaacggcagatatgcccttgacaaggttgtggaaaagctgaaagagatggaggaggcggaacaatgacggcaagccagacgggaggaaaccattcgcttcgctcggaggaacgcagaaaagggagagttcccagtccggcagaatttgtaatgttgtggctggcgccgacgacgcgggattacaaggacggaacggcgcaaacatgccggaatgtgcctgtaaacggcctgttgggacgcgcggttcatctgtatcccacaccaatagcttccgactggaagaaccggggaaacagggattaccgcaaagggcgggagttccaattacagacagcggttggtgggaagttgaacccgacgtgggtagagtggctgatgagcttccccatcgggtggacagacttagaagcttcggaaacgccgtagtcccgcagcagttttatccgatttttcaggcaattgccgaagtggaaaggaatgatcataaatgaggaaaagaaatcaattcctaatgaatgaacgattaggacgaacctgcgatgaacggatgctgccaaatatcaaagaattaattgcggaggcacagagaagggttgatcaactgcattcgatttatggggatacagcccaattagggagctttgtttcgaacttacctagcgttggttttaattcagtggggcattgtaaagattgtggctattatgaaataggagaggacaatttgccatattgccatcatccttacagcggtagatcagaacatccgcaaccagacgatttttgcccctatgggaaacgcaagtggagagacgataaaaaggattttgcagctgtgaaaaacgcaaattgcggcgcggatatgagggaggacgagcatgataaagggtaagtatgcagcacagatcgaaattgatatttcagtggatgaaaatactccgaacttgcttccgttcgatgaactgaaaaatgctgtcaaaaaagaaatgcgtgatgtcatcctgaccaagcttgatgatgaattttctgcaattgggactacgactgttattcaacagtttgcggatttgtggaaggaggtcgccgatgattaagacatgtggaacctgccggtggtgggatgataatggcgtctgtaacaatgatgccgctggaatattccagtctggagtaaatggcagttgcccccttttgggagaaggatgacgaggaaatgcggggtgatggggaatgatcaaccaagacctacaacgagccattgggcagacagcacagatagagcagggggaaatcatcgaactggaaaccgggagggaggaataggagaaatggattgcattttttgcggagagtggttcgtaagtagtggagattccactatctgtcctccttgcgagaaggcgatgaaacggttaggaatcaaaatgtcccctgaccgcgcgcgccaacttgtgcaggcggagaaggatgggcggtgcatgatgctgcctaatggacattatggcggcaaagatggcgaagaagcgctgaaacacgttatgtatgtggtcggaatcacaaataatgccataaaccgttatattgcagatgcggtcgcagagaaattggttcgcgaggaagcggcgaaagcattggaagaaaaccgctgcggtgaatgaaactacatacaaggatgaataaaccatgctcattatcaccattcacgtagatgctccgcccggccaggccatcaggattaaggaggacttagccatgtatttggagcggtatggggacgcacgggtggtgtcggtggtagaagaaaggccagactaccgtcagatggagctgttcagcccaacccccaggcagcccaagggcagaaaataaaggacagacaggggtgagccaaaaatgacacttcaagaattgaaccagcatttcgacctactggagcagctgtcggaagcagaggaaatgctggacgcactacgagctgcggcttgccccggagcacaaaatctatctggtatgccccacgcgccgggcgttagggaccaggtcggagacctcgccgtagagattgcggatatgagcgggagcgtggagaccctgcgatccgaagtaagagagagtgaggcccatatccttccgtacatcaccaacattcgggacaatcaaacccggctggtctttcggctgcggttcctgcggggtctcacatggaaagaggtcgcacgggtcataggagggcgtaattcggaggactcggtgaagatggtgtgttaccgctaccttgacgagtaaaagccgttctgccccgttgcaacaggtttcttgctattctgcaagcggtctgttaaggttatactcgtaaaatcttacatcaagccagacggtcatccttcggggtgaccgtcactattttggaaaggagggctttggccccgcgtttctcctttgcgcggaggtctgcaccgtatcccgggctatgacgaagaccttctccgcgctatggtcatggaggccgacgaggccggcgaagctctgcgcgagtatggcaccattgaccaggacaaggttgaggagatccgggagaccggggaacgatatgaagcccgtgaggaagcttcggcccaaaaggcagagcagtacatcccgcaggaaagccccgggggcgctccggcgcaggccgagcagacacagcggttcgttctttgcccgaagtgtggtgaacggatatggctgtgaaacgagtaccgtccgacatggacgttgtgaccgccgcccggcagcgcatcaagaatgtgttttccaacggtgttcccgtatacctttctttctccggcgggaaggacagcatcgttctggcggacctggtctacaagctgatccaggtcggcgagatcgacgcctcccttttgaccgtccttttcatcgacgaggaggcaatcttcgattgcattgaagccacgactaagatgtggcgcaagcggtttttactggccggcgccaagttccaatggtggtgcatcgaggtcaagcatttcagttgtctcaatgagctatccagcgacgaaacctttgtttgctgggaccggcgcaaacgggatgtctgggtacgccagccccctccctttgctattcgcaaccacccacagctccggccgcgggtggacaactatcagtcctttctcccacgggtaaccggcgacggtattatgatcaccggcgtccgggcggccgagtctatccagcgccttcagtacatggctgctctgaacatgggagcaaagggcatcactggcaccaacaccatctatccgatctacgactggaagacccctgatgtgtggctctacctccgggatcagcgggtggaggtgccggaagtttacctgcagatgtaccaggtcggggtcaatcggaaccagctgcgggtttcgcaattcttctctgtcgataccgtccccgtcctggtgcatctcggtgagtacgctccgaatttgatggagcgtgttcttcggcgcgagccgaacgcatacctggccgtgatgtactgggacagcgagatgttccaccgcaccaccaagaagcggcgggagctggagggcgaggacaagaaggattaccgcgccctcctgaaagatatgctgctgatccacccgggcgacttcttcaacacgccgcacaaaaaggatgtcgccaagcaataccgcaagctctttatacgcatggacggaatggctcggccccgcgattaccggaagatgtacgaggggctggtggccggcgaccccaagctgaggacgctccgagccatctatcaggatatctcctgtgcctacgcagcctacgccaagaacttccgtaagggaggtgaggcaaatggctgatgtggacctgttcgcaccactctcttccctgcaatgggtggaccgcgataagctccggccgaacgattacaaccccaacaaggtcagccgggaaaacctggagctgctgacctgctccatcgaaaccaacggctggacgctgccaatcgtggtacggcctgattacaccatcattgatggctttcatcggtggactgtggccggggcggaaccgttacggacgcagctcggcggcaaagtccctgtggtgatcgtgcgccatgaggacgcgtcggaagacatctacggcaccgtcacacacaaccgcgccagaggtacgcacctgctcgaacccatgaaggctatcgtcaagcggctgatgaatgagggcaagagcgtgagcgagatcggcaagcagctgggcatgaggcccgaagaagtattccgcctgtcagacttctcccgtgaagacttcctggcaatgatgaccaagggggtcaaggggtacagccatgcggagcttttgaccaagatataacgcaagaccacggagaggcgcatacatcgcgtgagagcggcgtatgcgccttgtccttggtgcaacccggggacgatgggcagagcgccgctgtggacgcgtatgcgcgttgcaacggcaggcaaaaggtactgtgacgccccgccccactaagctgcgggcgcgtcgaccccaaaacgcggtcagttatgaggtttttttcaggggtgtttccgttccgctttgagtgataccgaggaaggaggaaaaagtcatggcagaagaaaagattacggccgatacagaggtcagcactacggagctggcctgtgtcttgggcataaccgggcggcgaattcgccagcttgccgaggacggagatttggacaaggccgggcagggtcgcttcaatctgtgcgagtccgtccagcggtatatccggctccagtcaaagtcatccttgtccgaggaggacattaagctggaaaagaccaagaaaaccgccgatgtcacgctcaaggcgtccaaggcccgcatcgcaaagatggaggccgacgagctccagggcaaaatgcaccgcgcggaagatgtcgccgccatgaccgaggaccttgtctttacaatccgctcctcgctgaatgccatgcctgggcggctggctgtggatgtggcggcggtaagctctccggctgaggccgccgaggtgatccgccgggaggtccacaaggtcatgcgcgagctggccgggtatcactacgacccggagaaatatgaggagcgtgtccgagcgcgtcagaactggagcgccggcggacgcgatgacgatgacgagtagacgtgaagctgcccggctgaacaagaccatatctgaagcacttgccggtatgatcccgcccgatgacctgaccgtcaccgaatgggcggagcagaaccggcgtctatcctctgaggcatcggcagaacccggcccttggagaacagagagaacaccctatctgcgagaggtcatggacacctttacagacccgaaggtgcggcacaccgtcatggtggcggcatcgcaggtcggcaagtctgaggtcctgaacaactgcattggctacatcatcgaccaggaccccggctccatcctgttcgtccacccgaccaccattgatgccaaggagtattcaaaactccgcattgccccgatgatccgggactgccccactctcaaaaagaaggtggccgacccgaagagccgggatagcggcaacacgatcctccaaaagagctaccccggcggcatccttaccatgtgcggctccaccgaggcgcacgctctggcgtccaagcccatccgctatgtgttgggcgacgagcgcgaccgctgggcgacaagcgccggaaatgagggtgacccctgggacctggcgatggccagacagacgaccttctacaactctatggccttcgaggtgtccactccgaccgttcgaaatgccagcgccattgaggctgcctatgcaatgggaacgatggagcggtggaagtcccaatgcccgaactgcaaggggtatcacgaaatccagtggtcggacattcagtttgattacgatgaaatcattgtggccggaaagaaaacattcaaggtcacgaagatctactacacctgtccggggtgcggctgcatttcggacgaggtgaccatgaagcgagccccggcgaaatgggaggccgacaacccggcagcctacgagcaaggaacacgctcgttctggctgaacgcattcgtcagccagtgggccacttgggagtccatcatcctgaagtttctgaacgcggtcggcagctcccggaaaatgcaggtggtctacaacacctgcttcggcgagctatgggaggaccgcggcgatctggaggacgaggacacactgatggcccgccgggaggattacggaaaacgcgaggatggcagcgatgttgagctgccggagggcgtgctggtcttgacctgcggcattgacacacaggatgaccggctggaatacgaagtggtcggacacggccattttggagagacatggggtatccgcaagggtattatcatgggccggccggacgctgacgaaacatgggcacagctggacgatgttctggatcattcctacgcattcgaggacggagtaacgctgcggatctccgccgcttttatggacgagggcggtcacttcaccatggatgttcgccagcggtgcaatgagcgcataagcaaaaagctgttttgcatcaagggcttgtccgggtcagaccggccatttactgcgcccccaaagaagcagaaaatcatgatccaaaacaggttcgttggaacctgctggcaatatcagctcggcgttgactctggaaaggagatcatcatggacgacttgaaggttcagaccccgggggctcgcttctgccactttcccaagcgggatgattacggaagcgcattcttcacaggcctgctgtctgaggtcaaggtctatgaccccaacaaaaagaacccgtggagctggaagaagatccccggccatgaacgaaatgaggctctggactgccgaaactacgctctggccgccttcaagtcgttgccgaacaatctggacgccatcgaccgcagactcaaggcccggcgggcaggtggcggggttgccattgcgcgtcctgcgccccggcgcaccgtgaaaaagaagcagagttccgggatcgaccgatactatgacagctggtgaggtgcttatcatggcagataaaacagagctgaaagcgcggctcgagttcagaaaaaaagcgcttgaaaagctgcgagccgcctatctggctctgctggatggcggcgtgaagtcctatcgcattgatgaccgagagctgacccgcttcgaccttcctgcgctgaaaaatgagatcgaggagatggagggcgagttggacgagctggaaagcctgctggctgcggggcgaccgcgcaaggcgttcggggtcatccctcgcgactggtgacctttttcgtgaggtcacgaaaatgatatgggtacaagcccgaaagggctttgccacgggtggcccggcggagtttgctgctcctttcgccgctgggctgtccgttttttatgcaatacataggaggtgggcgacatataccgcgacaagaaaaccgggctattcctgcccgacgcagcacgcccccaagccaagggatacagcgagggcggcgccagcctgaccaggagggcgctccggggcttcgttccaagcagcgggagcccaaacgaggacatcaaccataacaacgcgaccctgcgccagcgggcgcggatgctatacatgaattctccggtggccacagcggccatcaacaccaaccgcacaaaggttgtggggatcgggctttcgctgaaaagcacggtgaacagccgcgtgctgggtctttccgtggaaaatgcccgggcatggcaggaacaggttgaggcggaattcgccctgtgggcagacgagaagcagaactgcgatgccatcggtatgaacaacttcaagagcctgcagcagctggtactgaaatcgtggttgatgaacggcgactgcttcgtcctgatcacacggcaaaagccgactccgcttaacccatactcccttcggctccatgtaatcgaagcggatcgtgtcagctcccccagcaacttcggagctattgggtacaaaggcattacggatgccactattccggaaggtgagcccggagcaggccacaaggtctatgacggcgtcgaggtcgatgaaagcggccgcgttgtcgcctatcacatttgcagcaagtacccgggcgagtggagcgatgtatccctgaaatgggcgcgggtgcttgcctatggggaaaagaccggcctgcccaatgtcctacacatcatggacagcgagcgggcagatcagtaccgcggcgttacctatctggctcaggtcatagagccgctgttgcaactgcgccggtacaccgaaagcgagcttatggccgcgctggtgcagagtttctttaccgcatggatcgaaacagacgtgaacccgatgggcaacccgttcaacgaggttggtgccggtgacacaggcggcgaagcggacaatatttctatcgacgaaaacgaatatgagatggctccaggcaccgtcactcacctgcggcgcggcgagaaaatcgtattcggcaaccccaacatcccgactgcgggctttgaaaccttcatcaagacgctctgcaagctggtcggttcagcactggaaatcccctatgatgtactgatcaaggagttcaacagttcgtattctgccagccggggcgcactgctggaggcgtgggaggcatttcgaatgcgccgcgcatggctcgtggatggattctgtgctccggtctatcgcctgtggctggccgaggctgttgcccgggggcgtatcaaagcccctggcttcttcgatgatccgttactccgcaaggcatggagcggcgcacagtggaacggccccgtacaaggccagctcgacccgaagaaggaagcggaggctgcggagctgcaggtcaagaacggcttcaagacccgaacccaggtcacaagggagcagagcggcgcagactgggaggagaatgtcacccagctcgcccgggaaaacgaacagcttgccgaggccaacggcggggtgctcccggctccggccccatcgtctacacagaaaggtgatggcgatgaagattaaccacaacgaagggagaaaaccatgagcggatttcagaaaaagcccggcgtcagtatcaaaaagccggtttattccatggcaactcaggatggaaccaacgcggaaatcaccttgtatggggacatttatgagcaacagccaacgaactggtacggagaacccgttgaaggccagtttatcacgctggatgaatttctggaggatctgaagcagattgatgggtgcaaggccctgaccatccgcatgaatagttacggcggcgacgccggcgtttccaatgtcatccacaaccgactgcgggaaatggcccgcggtggcgcggcactgacctgcattgtggatggcgttgccatgagcggcggcagcctgattatgtgcgcctgcgacaccatcaaggtcaatccgtccagcattatcatgatccacaaatgctggacatttttgtggggaggctataacgcggacgaattgaggggtcaggcaaatcagcaggacgcttgggacaagatgcagatggaaatctacaaacggaaaaccggcctgaccgatgctgatattctcgagatgatggccgaaaccacttacatgaccggacgcgagaccgtcgaaaaaggcttcgccgacgagctgatcgaagatgccgagccgcttggcatcgcggccagcgcagatggacggacactgttcgttcgggggcgggccatgcacatcacggcgggaatgttcctgccggactccatcccaacagtcactccaggggcctcagccgctgttctgacgaataaaaagccggaggaagtcgccggccaaaaaggaggaaactctatgactaaagaagagctccgggcgcagtacccggaccaggttgcagaggtcgaggccgaggccagagcagccgttgacacttcggccgcaaccaactccgctgtgcaggcggagcgtgaccgcctggccgccatcgacgaggttgccgggctgttcgatcctcagctggtgcatgaggccaagtatggcgataccccctgcactgctgctgaacttgcgctgaaggcggcgcagaaggctgcgaagcaaggcagcaagttcctggctgatgcagctgacgacgcagcagcttctggcgccggtgcagttggtgccgtcccgcccgctgacggggatggcggcgagaaccccatcgaacaggcacgcgctgacgctaaggcgttcaatgcgcggaagaaggaggtcagataatcatgagcaagaacctgatgaacaaggtcggcgagtgtggacaggataacctgattgctcgcctgttccctcgctccctgaccgtgggcgtcaagatcgttgctggcgctggcaaactggagcgcggcaccgtcctttccagaaagccggatggcacctgtgaggtgatggacaccggcggcacgcctgcctatatcctcgcggatccggtcgacgcctctggcggggatgccgttgccgccgtggcataccgtagcggcaatttcaatcccaatgcggtcattgtggccagcgactatacgctgactgccgctgacaaggacactctgcggaagtatgacatcgtgttcacgaacatgatggcggagtaaaggaggacatcggaatgaatatttacgacaccctgtatatgctggcggcggtcgaggagctggctcccgagcctaccttcttcaagcgccgctatttccccaccgacatggatctggatgtgttcggaacctctaaggttctggccgactacaaggagggtaaccgcaaggccgcgcctttcgtcatcccccgcgtaggtcccctgcctgtcggccgcggcggcttcagcacctatgagctggagcccggcaacatctccatctccaagcccctgaccattgaccagctgaccaagcgcggctttggtgagagcatcatgagcaccgccacccctgagatccgcgcccgccgcctcctgatgagcgacctctccgacctgtctgcccgcatcactcgcaccgaggagtggttggcctgcgcgaccatgctggacaacggctgcatcatgcgccatcagaccgacgatccggagatctatgaggatgtgcctgtcaagttctacgacggcgacaacaaccccgcacagtttacccccggcgctgcatgggcacacggtaaggacgagcacaccccgggcaactggtatcacgacatcattcagatgatcaagatggccacccgccgcggcagacccatcaccgatctgatcgtcgccaatgacgttggcaacttcctgatggaagacccctggatccagtacatgatggacaatcgccgggcagagtatggctccatcaaccctgaggagctgaccgagtatgtgacctctctggggcgcttcaacttcggcggccgacgtttggaaatcttcgtcaacgatggcacctttgaggacttcaccggcaaggagacccccttcctggaggctggcagcgtgatcgttaccgcccccaactgcggcaagggtctgtacggagccgtgacgcagaaggagatggacaaccagtggcacacccacgccggcacccgcgtccccaaccacctgtctaccatcgtcccccctgcggatgaaactgtggtgtccagccggcctctgctgctgcccaagaacacctccccttggacttctgccaagaaggtcttcgactgatcgaacagaggaaaggagatcgctatgatccagattaaatccggcacctgcggcacatcgcagggatataagacccgagcagatggcgagctgtcgcttccgatctccgaggaagcccggctggtcgctcggggcgcagctgaatatgttatgaggcccatcaagggcagtcctaccggcgttgcaacgaccgctggcggcggttctgacaatgccccgagcggtaacgagggtgaggacagatgccccgcggaaagcgcagaagagagctttaccgacctgatcgacaccctcgacatcgtggacggtcattttaccaaggaaagcctgatgaagatggggcgcaaggagatggaggatctggccgaagggctggaggtcgatgtaagcaaatgccgcaacaagggcgagatcgctgacctgctggccgcggtcgagcttcaggtcgaggaggatggcggcacaccgcctggcctcaccaccgaggagcccatgtaatgagcggcttcaaggacatggttgcggcagatagccacaatgtattcctgaacatcgacgagtttgcagagcggcggaccgtggagtatgacggagaacggtatgtggacattcccatcgtcatgagcgggctgaaggagaaagaccggcgccagctgatgagtgatcacctgcaggggctttatcttgtgtcctcggtgctgcactgcgcagcggccgatctgggcggcaaccaacctgagaagggcaaccgcattcgcatcaatgatacagagggcgacggaggatttttcaaagaattctacgtcgcctcttctgtctgcgaaatggggatgctccgcgtagaactggaggcaatcgacgaatgagtgatatttacagatcgcgtgagcggagcacctattatggcggcattgtggttgatgttgccgaggaaagccttgaccgtgtaacaaaactgctggcaggcatcaatggcggagtttacaaagctgtagggagcgcattgacacgcgctgcggcagccggaaaaaccgtcgcgaagcgggcggtttcacaggagtataccatcagccaaagcgaatttttgacccaaacgaaaaatatcaaccattttatacgggaatcatccggggaaatctccgtagtgtttggatttaagggttatgtgataccgctcctgaaatttaacacccgtacaaataacaacggtcaggtggtcgcccaagtcaaaagatccggggcgggagaagtattggatcgtgttttttctgcacaatcggccgtgcatgggcatagggtgatattcgaaagggaaggcttatcccgtctcccgattacagaactttatggaccggctacgcctcagatgatgtactccaacgaggctgtcaccgatgaaatcgaacagaagatggccgagacatatgaaaaacgtattgaccatgaaattctgcgcattctcaacggctggggaggataggacatgacaaaggcagttctgttggagcagttaaggctttttaccgccgaagccacaaaggatttgctccttcccgtggccctgcaaaaagaggaccaagagcagccccggccccgggccgccggggtataccggacgcgtttgcctgacagcaaagcggccaggaaaaaagcgccttacattctgcatcagatcatcacaggcaaggatgttcaggcccccggccagcgtcccaacaattcagccaccgtccgcaccatcttttgcgtctatcatcatgatgaacaagagggcgggcttgcgctgttgaaccttatggaacggctgaggattgctctgttggagcaaaggagcatcggtaagcagtttaggcttgatttggaagctgggctggaaagtctggtttaccccgaggatacagctccatattacgcaggagaaatgatatctgtatggaagctccctgttattgaaaggaaggcgccttatggcaaggaaggaaatgataatgttaaacaactctgcccagggacctgttttgaagcccaaagataacagctctggtttttactgttatatcggcccaagcattaccggcattatccagcatggaactatctggcgagggagcaggacggccgccctggccgctgcggcgccagctatcgaaaaatatcccctggtcaaaacattaatcgtatcaggggatgcgctgcccgaagcccgattaaaaattaagaggcccggcaatgccctgtacgtcaattacaggaaaattgccgggctgcgctaaggaggtcaaaatatcatggcgaatatgggtattcatgtcaatgaacaggccacggcggtcagcacgcccgtcgtggccaattccggcattccatttgtggtcgggctggcgccgggccattgcgcatccaatcctgcaaaggccaatttgccggtgctctgcaccagttgggccgaggcggtggagaagcttggtttttcctatgactggggaacttataccctttgcgaatttatgtattcccatttccagttatttggatgccagccggtcatcttctgcaatgtattggatccggcaaccatgaaaaaagaagtccaggcggctgatcacgatgtcgtcgaccataagatcagcctgcctttcggtatcatcaatgataacagtctggtagtacgcagcggtgaggacgaattggaaagggatacggattacagcgtcctttacgacgaaaaaaagggcgtctgcatcgtagagctgttgagttcaagcgaccattactcagcgcaatcgctcaatgttgccggcaatacagtgacgccggatacggtaagtgatacggacattgtgtccggcctgggcacaatcgacgcctgcatgaacatcacaggggtaatccccgatctgatctgtgcgcccggtttctcgcatatccccgccgtagcggctgttatggcggccaaagccgccggtatcaacggtttattccgggccaaagcccttgttgacgtatttaccggagataacggcgtccgggaagtttccgggctgctcgattggaaaaccaaaaacagcatggtagacgaaaaccagattgtatgctggccaatggtgaagatgggcgaatacaaattccatctctctacacaaatggccgggctgatggcgcagacagatgccggcaacaatggctgcccgtatgaatcgccgtccaataaggcgctgaaaatcgacggatgctgcctgctggatgggacggaaatcaatctgacctgggaacaggtacagatgatcgctggaaattacggcattgtaacggctctgaatttcatgtctataggctggacgttaaaaggcaactacaccgcctgctatcccggaaacaacgatgtgaaggattactttatccctgtttccaggatgttcgactgggtagcaaataccctgattcggacctattggagcaaattggacaaaccgatgaaccgacggctcatagatactgtcctggatacctgcaatatctggctgaacggactggtggctgacgagcgtttgttgggagccagggcggaagtgccggaggatgaaaaccctttggacgatttattggccggcattttgcgtattcatatctatctgacgccgccaagccctgcgcaggaaattgattttacgcttgaatactcggtcgactatgccactgcggcattgcagtccgccggttaaaggaggcaatcgtatatgagcaaacaggcagcatcctacatccagcttgagctttacgaggacagtgtaaatctgttgggcattgcaaaagtcaaactgcccgcaattacatatccgtgcgtcaatatcgccggagccggaatgatgggcaacatggaagtaccgttgtacggtatggtcgacgccatgagcatgacgatcaactggctcagccccactcaggacgcggtacggttggcagccccgaaaaagcaccagttggatttgcgggttgcggaagaatactgggatgtggaagcggcagaggaagggatttggccggaaaaatacgttgtgattgtccggccgaaatccactgaccccggcactgtagcgcctatggccgctgcggatacatccggtgaatatgcggtgtattattatgctgcctacagggatgggcagcaactgtgggaaatcgacaagcgcaatatgaagtgcgtcattatggggacggattatatggctgacgttcgaaaagccctcggaaaataaacggacaaaggagtattgtcatggataacgagaaaaagacaaatgcagcagaaaccggcggaacagcagacggcatgattatggatatggcggaagcggcggagaagctggaacaggaggccaaaagagcagacgccgattatagttcctatacccatgtgttccagccttcgtttatttatgagggcaggacctacgatacgcttacttttaactgggacaccctgacgggcaaagacagcctggcgattgaagcggaaatgatgctcaaggggaaaacgctgatcctgcccgcgtacaccggggaatatttggtcggcatggcagcccgtgcctgtacctgtcgggatgacagcgggaatcgaaccgtaagtacaaatacaatttgcgccttgccgctgaaagattttcaggcgatctgtaaccgggcgcggaattttttgctgcgtgcggggttgtagtcggcgacggcggactgtggctccgcaagcaatgcctgattttagcaaagtcgaacagcacccccgcgtttgattggctggatttacctctgtcggaatttaaggcatggattcaagcgcataacgctgtagccgcagaggcgtcggaaagccataatcgacccgttcgaaattaaaaacaaaagagggaggccaggggcagatagcccttggcctccccctttttgcagccggagaagggaggcggcgtgtggccagcaggaaaccgtatgaaatgctgtttgctttaaacgcccaaatgaacggcagtttcagcagcacgctatcgaaagcacagcaggaatttgtcagactgggaaaagagattcaaggtttaagtaaaattcagtcagatatttccgcttatcaaaaacagcagggcgcgattgatgctacccaaacaaaattgaataatctccggcagcaagaagcgctcctggtacagcagttaaatgcggctaagagcgcgacagaacaagacgccgccgctattgccgctttggaacgggaaaaattgaagctggaacagcggatcagcaatacaaacgcggctttggagcggcaatcacaaaaattatcggacacaggcgcgcgtctgaaagaagccggggttgataccgccaatctgtcacagaaagatgcggaattaaccgcccggattaaagagctgcaagccgaacaggacaaagccgccgagggcgcgaccagttttggcgaacgttccgtgcaggccattggcgccgtacagcaggcgcttattgccgccggcatagctgcggcgctgaaaaaaatagcggacgcctatatggaatgcgttaaaatagccggcgattttgaggcgggcatgtcaaatgtggaggctttgtccggggctacggccgccgaaatggaacaattgagcggcgtggccaaggaattgggcgctacaaccaagtttaccgcacaggaagccgctgacgccatgggctatatggcaatggcaggatgggacgccatagatatgatgaatggtatggacggcgtgatgcagttggcggcggcctccggcgaggatttggccatggtatcggatattgtgactgataaccttactgcttttggactgacggctgcggataccgctcatttctccgatgtattggcagcggcggcaaccaactccaacacaaacgtatcgattatgggtgaaacattcaagcaatccgccagtattgccggtgcattgggatactccatcgaggatgtggccgtggcggtgggactgatggccaattcaggcgtcaaaggcagtattgccggtaccgctttgaaaaacacctttaacggcttactggaaggagcaacactgaccggcgcggctttcggcgagtatgaatactcggcaatcaaggctgacggcaccatgaaaagcttttcgagcaccatcaatgaactgcgcgtctactttgaccagatgaccgaagccgaacgcgtcaataacgccatgaccattgccggggcgcgcggctataacggcctgctggcgatcctgaatgctgctgatgaagattatgcctctttgaccgacagcatcaacaattgttccggtgcggcgcagcgcatggcgtcgattaaactggataacatgaatggacaactgaccctgatgaactctgcctgggaggccgtgaaaaccactgttggggaacagtttacgccggttatggaaggggtatacagtgtcggtacggacgtactcacgcagatcaatgaactgttgaaggcaaacccggctttagtgaagggcacggctgcttttgtcggtgtccttggcgcagcagtcggcgctctgaccgcttttaccgcggtggccaaaattgcggcaaaagcatctacccttctatctatttctattcccggcgtcaatattgcgatgggtcttgccgctgtagtgggcgggattgtcgcgctggtttctgcggtcaatgagggcattccgcctgtgaaggagctggccgatgcggcgcgcgatgcgcaggaggctatggagcaggccaacgctgcctacgacgaaaccgccacacagacgcttgccacggcgcagaccgccctaatctacatcgacaggctggaggaaatcgaggctgccgcgggcggcgcggtgaaagaaaatcaggaataccacaatattctcgccctcctttcccgtacagtgccggaactggccgacagtatcgaccttactaataacgccattgatggcggcacagaagctctccgtgcaaatacggaagaatggcagcgcaacgcggaggcccaggcataccaggaatatctaaatacgctgtatgatcaacaaagtcaagttataacagaatctgctgaaaacagcatcaagcttacccaggcacaaatacaactggaatccatagaagaaaagcgcagcgatgcccaggaacgcatgaataagctttatgccgaagcgcagcaaaaggcacaggactattacaaagaattcggaacctggagcgaggctgcgacctttctgacgcaggaatactacgaccttcaaaattccatctacggccttgacgatgaggcatataaagccgaacggaccatcaaaaatttgaaaaaggccattgatgaagatgccgaagcggtagctgccgctcaaaacgaaatcaatgaagccgaagaagcgattacccggatgaccgacaccaccaaagatatgaccgaggccgagaaagctgccgcgcagcagacacaggagtttcagcagatttttgacggcgtcaccgcatcggcagcggcgctcacggaggcttacaaagcgacgtatgaagccgcaatggaatccatacagggacaatacgccctgtgggatatggccgcaccggctgttgcaaccagtgcagggagcatcaattctgccctggaaagccagatcacctattggcagttatatgacgccaacctgcaatccctgacagaacgcagcgccgagattgagggcctgagcgatgtcatcgcaagctttgccgatggcagcaaggagggcgtgaacgcggtcgcgggccttgccaaggcaactgatgaccaattgcgggaagtggtcgccaattacaatgccaataaacaggcgatgtctgacgcgtccaacagtacttcgatgctggtgaacgaggttccccaggaaatagacaagctgcaaaaagaactggaggacggcgttgcggctatgaaccttggctccgaggcggccgagagcgccagggctacaattcagggatacatcgacggattggatggtatgcatccagaggtacaggccgcattcgcccgttttgcacaggcagtgccgcaaactccggccctgccgggaaacggatttgccccgatcgcctctttacatggacgcggatatgctactggtacggaatcagcggaacctggctttgctctggtaggtgaaaaaggaccggaattgatctattttaatggcggggagaaagttgtgaacgcggcacaaaccgccgccatgcggtcacagcctgccatttccgcgctggtcccgcctgtcggcggcgccaattccccggttacaatccaggtttcatttaatattcagggaactgcctccccggaaaccgtagcgtccctgcaagaattcggaagtgaatttgccgaacatgtcctggatgttatcgaacagcacaatattgatgttacaaggagggcctatcgatgaaaaagtacacaaccgtccagggagatatgtgggacagcatcgcctacgcccagcttgggaatgcggattacgctgataaactgatgaacgcaaatttgcagtatcgggaatattacatatttcccgccggcattgtcctgaacctgccggaaataaccgggcgtgtcagtgatggcatgcccccgtggaaacaggtgggaggatgagcgacaaaaatctgtcacgccgcgcggctgcggagatatcttttaacggcataaatattacatcgtctatcaagccttatcttctgtccatgacctatattgataatgaggaggacgaaacagacgatttgcagatcacccttcaggacagggaatctatctggttggaaaaatggctgacagaagcggttgacgccgccgcgtccgcccccggttcggcgccgggaggttattccgtgggggatatcgtccagtttacaggatcgtttcactatatcagttctaccgacgacgccggatatacagcgataccgggacctgcgcaaatcacattgagcaatcccgggagtaagcacccctggcatctgattcataccgataatacctctaatgtctacgggtgggtcaacgaaggggacttccaaggcatggacggcaacggctcggagaataacagcagcgccggctttaaaattgacgctgtgattgtccgggaaaactggaatagcgacggtaaggataagctgctgccctgcggccagttcgagcttgacagtgtggacgcttccgggccgccggccaccattaccattaaagccacttcccttccttttggagcgcagatcaggcaaacgaaaaaatcccatgcatgggaagcctgttcattatccggcatcgccaaagagattgcgcgcagcaacggcatggtttgtatgtatgaatcggtgggcgatccgttttatgcgcggctggaacaggtaaaaacaagcgacatcgcttttttgtccaccctctgccatgacgcgggaatctcccttaaagcgaccaacagtatccttgttttgtttgatcaggcggcttatgaagcgaaatcgcccatctttatcatcaggcagggaaagaacgggggctatacaaaatacaagatgaacatcggcacggcgaatacaaagtattcgtcgtgccgcgtcagttatgtcgacccgtctacaggccgatgcatcgaggcgacggccaggacggaggattataatgccgatgcaaagaacaatcaacaattggaaatctcggcaaaggtgtccagcatcgccgaggcaaaggcgctggccgaaaagcatctgcggctgcacaacaaatacgccaagacagcgacatttaccttaccgggaaatcctgatctcgtggccggggtgacaattctgctggaggggtggggcgcttggggcggaaagtatatcatcacgcaggcgaaccattctgtcagcgggtccggctatacgacgcaaatcaaattgcgtaaagtactggagggatattgatggcatcggatacaaacctggagaagttggtgcgtcttgggacggtgacggctgtggacgccggcaaacggcaggcgcgggtaaagtatgaggatacgggttcactctctggatggctttacgtcctcgcggcgcccccatccgtcccggactatgatgcgccgcagcgcacagagcttgaagaaggcggcagcggtgaagcggcttatgaaagccatagccatgagctgatcataaaaccatggatgccaaaggtgaacgaaacggtcctgatattgtacctgccgggagataacacggacggttttgtcctggggagggtttaggcatggcaacgatcggatgccttggggatgtggcctttacagtttccgattccgtcatccggacgctctccaattttcaatggtccggttctgcgcgttatgcgacccatcagcggcatttggggcggggacttctggaatttacagggacggaccccgataagatatcttttgatatcacactttccgcacaacttggggtaacacccgcaaaggaaatcgccaggatcgccaaatatgtaagcagcggcaaaaagctgcctctgaccatcggcagtcatgtctatggacaatacagatgggtgattctgagctacagcgtcaaagcgcaaacatttgataaatacggtaatctgtatgttgcggtgctgtccgtcagcctgcaagaatatttgaggaggtgaaaacagatgacctatacgatcagcgccgcggatttacgtaatatccggctgaaccaaaccgatgctttaaactctgttattcaaaatatcgcgatcattttatcgacagcaaaaggttctgttcctctgcatcgtgactttgggatagcaatggacgcacttgaccggccggtttctgtcgccgaagtgatgatgcgggctgatatccgcgaagcgatcgaacggtgggaaccgagggcgaccgttgtagatatcgccttttcaggggacgcgtccgaaccgggcaaattggtaccaacggtagaggtggagatcaataatgggtagaaatacagaatatcagtttatctcaacggatgcggccgaaattgtatccctgctgacaacagcctatgaaaagatcactggtatcacggtccatcctgccagcccggaacatctgttcatccgatggatgggcaacataatcatacaagagcgtgttttaaataattataccggcaatcaaaacatcccgagccgtgccgaaggcaggaacctggatgcattgggcgaactgtttttagagcagacccgccccggagccaagccagcccgatgcaccgtccggtttgaaatttccgaggcgcagctatttgccgttttggtgcctgcgggaacaagggttacagatacaggaggcgtcctgatctggcaaacggaagcggatatctatgtgccggctggtgaaacctctgtggacgcggaagtggtatgccagacatccggtacagtaggaaacggctatgtacccggacagattgataccatcatggacttgtacgattactgtacaaagtgtgtcaatatcactgcatccgacacaggcgcggacatggcgacagatgaagaatattatgaacttatgcgggccagtatggacggatatagctgcgccggcgccagaggcggttatatctactttgcccggcgtgtcagtacagagatcgcagatgtaatcgccaactcccccactcccggcgtggtcaagctgtacatattgatggaaaacggagaacccgcgggagaggaaattaaaaacgcagtattggccgcctgcaatgaagatactgtgcggcctctgacggatcaggtatttgtagaggatgccgaaaaaatagagtatgacatttcctgcacctactatatacaggagggcgtacaaaaaagcgcggcagaattaaaagcggcggtaaatgcggctgtaaaagaatacgccgcatggcagagcgcgcgcatgggacgtgatatcaatccgtcctatctggtgggattgcttatgcagaccgggattaaacgcgtggagttgaccgcgcctgtatttaccgtcttgcgggatggaagcgacaggaccgtcccacaggtggctgcgctgcggtcgcttgatgtggttgacggagggtacgaggatgaatgatcatggcctgacaacggaaaatttactggcgtcgttccccgaagcattgcggcatgatgcgtcgcttgcggctctggcctctgctgtcgcggatatcctgtctaagaggccggaagaaatcgggcgggctgccgtttatccctcgattgatgacctggatgaatcgcttttggatatcctggcccatgattttaaagtagattggtatgactacaattatgacgcagatataaagcgagcgttgtttaaaagcagcttcgccgtgcaccggtttttgggaacacgaggcgctgtaaccagggcgttgaccagcatttattctgccgcatcagtcaaagaatggtttgagtatggcgggaatccatattactttaaaatactgttgtacgatcaggatatgcccgtttccattccggctaaagaaatcagaaaggccgttgaattctataagtccctgcgttcccacctggaaaaaatcacgatgatcatcgaagccgcggcgcggctcgaaatcggattttcatggcggcttgcaatgcggacccgtttaagcgtatgggggatgcatgaaatccggctgaacggcagccgcggcttaaacggcgagtggatattgtccagcgtttgggaccggggcgcgcattttgagaaatttgctttgcatcaccgaaaacggatgccactccagatgacagtatatatgaccatcatgcaaagagccggatttgagcagcgggacataccgaaattgtcccgttttgccgtgcggacccgaaacaatgtatacagcccgcaaacgatgatgttggacggttcccacaggctggacggcggggggcggcttgggactgtgtttatacgtggcggcgtattgcgggcgtgcgcttttcgggcgtctgcaaatgccagcccgtgtattaaggccggcctcatccgaaacaacatgtggcgcctggacggttcccgcagtcttgacggtgagcagctgttgaacgcggatatcattacaagcgatctttaaatcatggaaggaagggattattttggcggagaaaaacagcatcattacaaaagcgcggcggattgcgctggccaaattaacggccggcgtaattgacacaatcccgccggtcgcctttatcgccctgggggacggcggggtaaacgaaagcggggagcctattgccccggatgtggaacaggaggctttgacgcatgaggtttgccggtatgcggtacagaagcctgtcgccttcccggtggagacaacggcgcgattcgtaattgttatcccggaggatgaacaagccaaaacaaaattttccgaaatggggttggtcgatacagaggggaattttgttgcaattaaaacaatgtatgtgaagcagaaggatgacgatgtggagttttcctttaccttcgatatggaattttaattggaggggatatttatggcagaggtacataattcctggcaggatacaatgggtgaaccttatccgattccggagaatccagtttatgacgcatccaatattctaagaccgacgaccatgacaccggcccatgcagacatgtttaacgagatattttcccgcctgatcgtcaatactgcggcagtcaagagcattgctgacagcaaagcaggcactgacaccgctgcgtctgatcaggatggattgatgtcgaaggaagataaaaccgccctcgatcaagcgttgctgaatattgccgccttaagcgggattttgggcgacggcacggcaggcggcgatttacaggggagctatccaaacccggcaatcaatcccgcaaagctgacaggtatcaaacctgcgtttgcgcaggcagcggcccgcgcgaatattaccaatggcgataccctggcaattatcctgggtaagatcgccaagatgtatgcagacttaaaagccgtggcatggagcggcagctacgccgatttgacaaacaaaccgtccagctttacgcccgcggcccatacccatgacgaccgctatttcacggagacggagataacaacaaagctgaacgcaaagtccgatacgacccatacgcatacggcggcgcaggtaggcgcggctgcggtgtccagcggtacatggacgccaaatctcaacgacgcatacaatgcctgctttaccaacacaaatgcaagcggcgtctggtaccgggccggaaatatcgcactgttttacttccagacccaattaacccgaaaatccagcaacagcgcaaacatgtattgtacgacgccgtttgccggccatacgttcggagaagtgattctgcgcgggccgaccagcccaacgcttagaaagaattgggtattggcaaacacaaatacaaattccacctggatgcttatacccggaggcgcgtttgcgacagaatcacagatgtcggtaggcacggacttttggtattacgggcatggcacagttttgctttaagggggcagtatcatggataaaacaacgaaaaaaacatatgacggcctgtgctctgacttcgtttttattgagacacaggattttgaggatggcacaccaaccaccttgccgcaccgccagatgttttacaacacggaatcaggacgagcaatgctggcggaagcagcgccggagctgctggatgaaattttagcggtatggggcgatcaaccggcggccatggacggcgcggaaatattggagccttttccgaccgtggaagaaagcgtcgaatctctgaaggcgcagatgacagacgcgcagatggcgctggttgaggcatacgaggcggcggatgatcaggcaacgacgatcatgttggcgcagaccgaagcgtatgagacggcggacaggcagaacacagacgccatgctggcgctggcggaagtatatgaaaccatgatcgcactgcaaacgcgtgtgacggcactggagggaggtgaagtaaatggctaaagtatacgcggagctgattcgcaagggcttaaaggcaatcggggatgtgcccaaggccctacaggccgaggttaaggagctgctcgaacatgagtagcttttttcttttcctcgcaaaaatcttctgccggaaggaggtgcgcataatggcggttgtttacgcgacgctgatcgtgaaaggcaaaaagacgctggaggacgtcccggcgctgctcaaagaacaggtgcgggaaattctctccgctctcgatgtggatgtacagtaacatatgatggggccgggctggcggaacagcccggccttcaattttgcccagggggtgtaagtaatggcggatgagaaatgcatcgtagacccgcagcgggattgccttggcctgcataggaggtagaaatcttctaccgctttatcggcaaaattgattaaatgacatcaatatctttaactatgtgataccggcggtgggcatttgccgcctgtatgaaagccgccgcatcctgtccagacgttttcatccgtgcggacggcggactcagaagctttggaatgccggccagaagaagctgttgtagcagcgcatacgaaccccggggggaaactgtctgatttcgccggccctccatcaggcgtaccgatgcatcggtacgctccgacaggccttgcgcttgtgcgggctgttcgaaaagaagcgcgggatatcgttgtccctgtccgtttaaagcataaacgttcgcccacgccggcgcaaaaagcgcgctggcgcggcctgaacgcagcatcccgcccgacaagcctttctgtgttcctgcgataccaaaaatacgctccaaacgcctggagggatttggaggcggcaataccgccgcgggcgcaagggccaaagtctggaacgggaacccatttcctccggatattccatccatatttatcccagggcgcagcgccagcgtaccgccaaccggcatcgccatggggtacagttcggactggggcgcccaagcatccaggcggccggaccaggacgaaccagaccggccgcccgccgcataccgctgcaccaaaccggctgtttcgcggcccgcttgtccttcgcccggcgctgaccgctctgtgcgaaaggctgtccgcaccatccggacaggtgtccatgtaaagcggcgctgctgtccctgcccttccgatggtgctttttccttgtaaagcagcgtgctgtcagctactgctgcaaggggacgcgtccatgctgtttgccgctgcggcgcgtatgtccattcaatcagtccaaccggctgtctcaacgtccgcgccagcggcggatattcggcaggatactccgctgtacgcgggctgtccggccgcaccttttgcgcggccggcagcttgcgcaggccggcggccgcggcggctgtctgcggataaaccgcacggttcacgctccggctctcaaggcgttcgcgccgggtttcagccggcggcagcgcgcggcccgcctgcgcggtccggcgctccaaaagctgctccatccggcgcagataatatgcaggcggctcatcgcttgagccataaagctgaaagagcatgcggatattcacaggcgggaaggggcggctgtgtactcgctgtaccggcgtttcctgcacgccctcctccagatcgaccatggaaaaccttccccatccgtcgggggcgcgccgtactgcccgctcggttatcctgcgtgcaaaatcgcccgcacccgccgtctgaagcgttcgtccgccccccaggcggctcgcctgtacggcaagccggccgaagcttggtgtgaacgccctgacagttgtatgcaattttccactcaggcagttcatccgtctgtgccctccatggtgaaataagagtacccccacccatattccaatgtctttggtcaacggacagggggaaaacgcctgttacatgaccgccgcggccatttcctgccggaacgaggaaaatccttttaacagacttttaaaacagctgcagcagcccggtgtgcatcagttcaatccgggaaatggcaacctgcccttccagcgcattgaggatcgggccttcatatttgaccggatacgcgtcagtaatcgtccagccgtgcacggggacgcccttttcgttgcagagctggatcagccccagcactggcgttgtggtgccaagcatggccgcgcgcatccacagctccatttggaaactcgacataatcccaccctccagaataagccgctgggggacagtgtttcgtctaaagaacagcgggccgtcgttgcggccgccctccgcataagtttccatttcaaattcaaaaccaattccctgtaccgatgaaaaattaccgtcgagatccacaccgatcgccacatggaaataacagtttagattttcatcaaacacacccataccgatcttcccctttcacatcgcttcatctgcctgccggcgcggccagataggagaggatcgaaccgatgctcttatcagaggtcccggtggaatcgggcgggtccagcctggtgaacccttcatgcgcaagctccaacacttccagcgccacctcgctggaagccgcgttgaggtcggacacacgataggaaacgggccaggcattgaccagttcccaacgcggcccgtcgttgcctgcgtcgtccagcagggtaatcgtcaccagcctgcgctggattccggtcggcccgctggtgccgtccgctgccgcggaatgcagccaggcaagcgtgtccagttcaccgatgattccacgtgaaagccgcacgttgccgtaccgtgtcagcccgggaagcttctgcactgttggacggctggcatttcccgtgcggtattccaccacgtcgaccgtagcttccaggccggacacctcggaaaaggcgcccgctgtgatcgattcgatctcaaccttgtatcgaaagacacggtatggatgggttaaaatctcggtcgttgcgccagatgccatagttcattccgccgcgtcccgcggcagcgcctcctcccgttgattttataagccgtctgaaaacggccgttcaggcttcaaatacattttttggggtcccgttgagccgcttgttgatcttggaaagctccgcgcaccaccgcctgcgttcccggtggtcgaggttcatgacctcatcgtgcccccagtgcaggtaataggccagaaacgccatttcctcgtagagcctgtcagaaggatacaggacaagccctactcgatcaaaaaatccagcggcagctcaatctcctcgccgcatttgggacagaccgccttataaaccggcgtgtcggccaggttgatcctctggtaaaggtcctggagataggcgatgtccaccgtaaacaggttttcaatcaccttggtgctgatggcgggcagcgtacctagctttgtgatcacccgcgaaagcaggatgatcgaaagatatcccccattttgctggacacgcgggtcgcgcagcggcaggatttcatccgccgccgtggccagacgcatcgtcccgctgcgatggacctcgccgttctcatccacatagccgcgcggcagcataaattcaaacgtcgtctgcatagtaacctccggtatcatcataagcgcccgcgcgccgcccttttaaggcgcgcgcgggccgtcaggatctgattgatcagaccgcagagggcgttccggcgtcgccggagcttaccctagtgagtccctcgtggcaaatctcgatcgactcgatggcgacctcgctgcctaaggcgttgagatcggggatcgagtagcggaccggccaggcgttgatgatggtccactgcgggccgtccgcgcctgtgtcgtcgatcagtgtaacggtgatatttttgcgctcgacgcctgtcggcggcgcctggtcgctggaggcgacggtataaagccagtcgagcatctccatatcgccgacaacgccccatttaaaggtgatgttgccatatttggtcagtccgggcagcttgcgcggggtgttgcgcaaatcgtcgccctccctgtattccaccacgtctacattgagatcaaaaccggaaacctcgctgaagccgccgcgggcgataccgtcgatttcgacggtgtatcggaatgttctgtatgggtacctgatggttgagtcagccatagttgcttatcctttctatcagattcacatccgctgccgtaatcagccggcggattcgaccgtgtgctgtgtgatgcggaagatcacaaattcggcgggcttgaccggcgcgatgccgatgttgcagatcagccggccgttatcgatgtcgtcctgggtcatagtgctgcggccgatattgacaaagaacgcctcgcccggcgaggtgccggccagcgcgcctgagcgccacatagaggagaggaacagctcgatcgtgcgctgcacgcggccccacaaggcttcgctgttcggctcaaagaccacccaattggtattggccttgagggattcctccacaaaaataaagagacggcggacgttgatgtatttccacagcggattggacgaggctgttcgcgcgccccagacgcggataccgcgcccggtaaagctgcggatcaggttgacgccctgcgggttcaggatatcctgctcgccctcgttgtatggacaggaaagcccggtgcatccccggacaacctcgttggcaggggccttctggacgccgcgctcggtgtcggtgcgggcatagatgccgaccatcgcgccggaaggcggcatataggagcttttgcgcgccagcgggtcaaagacctcaagccacggatgatagagcgccgcatagctggtatcgaacatgttgcggtggtcgagcacatcgccgaccttcttcttgtccagcgggatgtcgagaaccgcaaagcggctcttggtgttctcacagtgcgcaaccagcgcgagttgcacgtcggaatcggtgacgcccggaaccgccatgatgctgacctgtgcgttctccaaaaacgcctggataccggtgcgcttgccgggtccattatcggatcccatatagtcagacgccttggtccctccaatattgccgtcgctgccgccagagaagccgagcgagaggctctcgcccacgccgccgaccgccttatacggcggcatcacgccggccgcttttgccgcgggggccacggccggagccttctcgtccttcttgtcgtcctttttctccgcgggggccggggcggcgggctgcgccggaaccttgcccacctcgacggtgacaagttcggatttttgcatacgggccgcgatatagcttgacgcggactcattgagcgaaacgttcagatatgtttcctcggcgtcctcaaaacggaccgaaacgttaaattcacaggtcttgatgacctttttcggcagcagattggtatcgacaatatcgcagccgatcggctcctcaaaagagagcacgccgtcaatcgccgacttgaccctgttgtgggagagcgttctgccgtcgtaaaattcaacgacgtcgccggctgtaaagccgtcgcagctcttgacacgcacgctgcggtcgtcaatcgcctcgagcgcctgtgttttggccttgctggccggggtgattgtcacgcgcaggcggtcgccccattcgcccgggttggcggctgtgaactttaaaaccgcagagccgctggtggcgctgcacttcgcaccctgcggcacaacgcgcatgataaacgcacgggaaccgccattgaggaaaaactgctccaccgcatagggcagaaagcggtaatcgccgtacttcgcctcggacaagtaggagccatacatccgctggtaatcggcaaaattggtcacaagctgcggacgcccgatcacgggtccgcgctccgccattccaataaagccggctgtgctggtgctgaccccttccattgggaccgcaccggattcaacttcctcgacatagacgcccggtgataagtactctgccataacaacgttccgatttccctgcgaaatcggatgcctcctctcgtttttgatagattcggttggatgcctgaaatataatttatcgtaaattggccctttggccagctttacaaaccaacgcttttaagcctcggcggatttcctccagcccgggcaaacaactcccgccaatggccggataccgacgcgcaatgcgcgcccatgccgcgcaaaaacagctccggcgcataaaacgcatcggtcaggtccacacgggtacggacgacgacggcgccgtcctccaaatagaaatgcccccacagatcaaccgcgttgatccggttgcaggcatacaaggcttgcgtctcgtcctccatgcggaagggatatctggagtagatcaaaacggcctccttttgttctacacagacagcgtgccagcgcacccgcccgtcggtaaaaaccaggtgggcttcctcccccctgacaaggaaatcataacccgcctgctccagcagagatgccagcgtatccatcgccgcctccttttaccgcccagggcgctggcgccggtgtgagcatggtcaattccattccgtcaaaccggacagaagccatatgcggcgcttcatcgggggatatcctgttttccgggagcgcctgcgccgtccctctcagtcccggcggcgtccgtgcgcatacaggatcgggcggacggtccggcgccgcgttgatgagccgcagcattcggctgttgccaagcgctgcgcataactgccgcagcgtttgacggcccaatccacgcatacctttggcggtccgcagggccgccgctgcctggaaagaccggctttggatgggttcagacgtctgaattagcggcgtcctctcctgctgcgtcctctggctttgattgttcgccggcgacgctctctggttcatacccatcctccttttgactgtaccgccgggcctcgccgcggcggccatcctccggcggcatggcggccgctgtcaattccgcagccagctcctctgcaaagccctcggcggaaaaaagctgctccgcctgctcggcattgtcgcgcaggatgctcaaccggctgataaactgtattttctgagcctgttttctttggatcaatgcctcgagactggcgatgccgcggcggagcacatcggcttcctcgcggtttgcctccccgatttccagctccttcagacgcccgcgccagacgtgcagcgtcatttggtcgtccctcacggataaaaatgggtacaccctgagcaggatctcattatctgcctgcgcaagaggactctgtggtccttcggcggcctcagccatcgtctggaacaggcggcccgcgctgcgcagactgcctaccaccaggccgacggcgcttttaacgtcctgccggttgtagacgacctgtccttcgttacctggcagattcttctgaactgagcaagcccccttgaggatttgctggcgttcattgaccggctccggctggccaagcgtccttttgagactgcttatcagcatcatacgtccctgcccgccgagaatcccggccgcgagcgttccctttgaaaaagcggcgtccgcgaatttttgcagccgcagcccgctttgccgctgcgtctccgacacctgataaggcatctgctccgccgccgggcgggccgctccttcttcaagcggttgtccgctctgctcaagcatctgtccggtcagcctctgcccttccagagtaaaacgcgtggaaaaggcctctgtaatcgagtaaaccggatcgcgtgttctgtatccaagatccggcaggtgcgcgagcctgcaaagctgatcgtgcagctcccggcgcaggaaatccccgccggaaagctgtttttcaaagcgcccggagcgtttcctcctggattcacggtacaacgcgccttcccccttgttatagggttttaaaatcagcaaaggccgcccttcgggtagctcccgccggctatatcggacaaggcgtcgtcagaaagcggggcaaagccgccgtcctgccaatccagccaagcctcctgcgtttcctgcgggttcagcccggcggcctgcgcggcctgttcaaaatcggttcggtcggacagcctgtcggataaggtatgagccaacaatctgcgtaaagcatcgctcattctaattcctcctgtgcatttatcgcagcgtttttttgcctggcatcttatacgaacggacggcaaaaaaatcccatattttttctgattgataaaaacaaattgccgctttattctgccaaaagcgcgtccatcccgcaaaagcgccttctttaccaagcgtaattttttattttttacgatacatcttgaaaatctcctattcttcattcaaattcaggaaacgggcaagcgttttcactaattatacatattgccttttgttttatcgtgaccttgtccaaacagcttgttcgtatgtttggatacatttgcggcataccagttgcaggaggcgatgcaatttgtacccatatcacaatcaaatcaaacggcgcattcgcgccggagagctggccggatatgcctttgtcagcgactatccacgcatcggcgaggcgttggtgctgtactttacgacgcctccgcaggtgcgtcccattcgtccgcaccgctatgcggaatacgctgcgcttctggcagcctgggaaaacggcgctttcccgcttttttgaaagagtccggccaaaaaatttcgtcagcttttcccctcctctgatttaagaacttgacaaaccataaatatctgatattatgttagtaataaatagatattatctttaaaaacataagattaaggagcgattgcatggaactgcgggaccgggacggcttgaccgaacaggaatttttagaacgatatcggccaggcgattatacgcgtccatcggtggcgtgcgatatggtcatttttacggttatggacgcggatgccggcaactaccgccgcctgcccgaaaagcagctgcgcgtgctgctgatcgaacgcggcggccatccatttctgggatgctgggcgctgcccggcggttttgtccggccggctgaaaccgtggggcaggccgcagcgcgcgagctgcgggaggagacaggcgttgaaaacgtctatctggagcagctcggcgttttcagcgatcccggccgtgatccgcgcacctgggtcatgagctgcgcgcatatggcgctgatcgggagcgggcaggtccggctccaggccggcgacgatgcgcaaaatgccgcgtggtttctggtatcatgcgcgccgcagcaggaaaagccggcacggttcacactgaaattgaccggcagcgacacgacgctttgcgcagtggtggagcgccggatgacgacttccgccggcgcggaggaatacacaatcatcgaaaacgacgggcttgcattcgatcatgcaaaaatcattgtctgcgcgctggagcgcctgcgcgcgcagacagcgtccggcagcgcggcttttcatctgctgccggaacgcttcacgctgaccgaacttcagcaggtgcacgaggtcctgctcggccgcccgcttctcaaagcggcattcaggcgcaagatcgccccgcttgtgcaggagacggaccagatgacacagagcgccgggcacaggccctcgcgcctgtaccagcgaaaacaggaggacagaacatgatttgttacgatctgaaaacgcttcagaaggcttattgttcgggcgagagctgccgtttcctctttttttgggggcataccccgccggccgacgggcatatgaatgaaagctgcctgagccagtggtggatgtgccgtttctcggtcgacggggtggaatataactgcgccgagcaatatatgatggcggaaaaggcccggatgttcggcgacggcgaaatgcttgaaaaaatcatggcgtccaaattccccaaggagatgaaagcttatgggcgcgccgtgcgaaactttgatcaggcggtgtggagcagccgatgctatgagcgggtgctttccgggaatctggcaaagttcgggcaaaatgctgatctgtgggaatttttagccggaacaaagggacacatccttgtggaggcaagcccgcgcgacaggatttggggcattggcatgggaaagcaaaatcccaatgccccaaatccgacgctctggcgcggtaaaaatcttttggggttcgcactgaccgaagcgcgcgagcttttgcagcggcgataggggggtgctttaatgaatggggagctttatcaggcgtgtgtccttgtggcggcggtgcgccaagcgctgcgcgccggcactttttcctataagggcgctgactacgaaaaaaccattcgtttcaccttccaaaacggcgcgcgggcggacagcgcagccgattggtaccgcgaactggcggcgcgccgccttcgcgatatcaaactgcttgcgcccacagtgaccggggaccgcggactgctcgccttttcgggcggcacgccttttctggttgcctgcttttacagggacaaagccgccggctggcgcgccggttgggaattcgaccagtctgcgcgaggttggaatatcgagtggaacgaagcgccgttcaaaaacgcgcccgccgcgccgccctgctttcaggaatatcgcgaagatttctccgcggtgctcgcacagatttcggaactggccgtgcgcatcggggagaaccagttcgccgcccaattcgacagtgcgcggcgttatctgacagaccagcatataacactgccggattggatgcatatccgtctgccggaaaaaaacaaggccctgctcgctgctgcctcgcgcgcgtgggtgttcggcggcatgggcagctggaacgacagcccgccgtatctggcgcatgaacagggccttgacggcgactatgaacggttgtccgccgcgctgtaccggcagattatgttggcggtgctgtacgctgtcaacgaatggtgacgcggcggacccgactttttggaaagaggattcattatgaaccgaaaggcaattgcaaatgaaaccctgcgtattttagagcaggggtggtatgaatgcgatggcgagcgcattgaaatcgccggtatgcatcaggcgtctctggcaggcagccgcctgatcacgccggaaacacagcccacgctgccccccatgcctgccgcgcgtgaaaaggcaacggcgctttccctcagaaattgctccactgtgcgcgcagtcatcgaccttcgcgcgcagggagccgggcgcatcggcgtgctcaacttcgccagcgccaaaaacccgggcggaggctttttaaacggcgcaatggcgcaggaggaaagtatcgccgcgtccagcgggctttaccgcacgcagacaatccatccggagtattacgcgcgcaaccgcgcctgcggcaccatgtgctataccgactgcgccatctattcgcctgatgtggtatttttccgcgacgaatggttcgcgctgctcgatcgtccggtcacagcgtcggtgctgacgctgccggctgtcaacttcgggcaggttctcttaaagggcgaggacgccgcgcacgcaaagcgcgtgatgaaggcgcgtatgcggctggcgctcacgctctttgcggcgatgggagatgaaaacctggtgctcggcgcatatggctgcggggtattttgcaacgacccggaggatatctccgcctggtgggcctcgcttttggcggatgcggactttaaaaaccgtttttcctccgtcaccttcgccgtgctcgaccagtccaaaaaccaggcctgttaccgcgcatttgaacgccgcttcggcacacaggaggtattctgatggagcaatccaaaagcgacgagacgctcggccggttcctgagccttgtgctgcggcacaaccccgcggcggcgcagatcacgctcgacgaacacggctgggccgacgtagaggcgctgcttgcgggctgcgcccgcgcgggacggcgcatcggccgggacacgctcgagcgcattgtgcgtgaaaacagcaagcagcgttacagctttaacggcgatcatacaaaaatccgcgccaaccagggccattccatcgcggtcgacgtggagctgcggcaggcgcagccgcccgcgcgcctgtaccacgggacagcgatgcgttttcttgaaagcatccgtgcgcaggggatcacgcgccagtcccggcagcatgtgcatctgtccgccgactatccaacggcgctggctgtcggcagccgccacggccgccctgtggttctcgccatcgacgcggccgctatggcgcgggacggctatgtgttttaccgctccgaaaacggcgtctggctctgcgagcgggtgccgtggagctatgtcctggaggatggggcgggccttgccccatagccggcgggcagataacaaaaaccatcgccgcgcggctgttgccgtgcggcgatggtttttgtttattcaggtatagcgagaaaatccgcgataatattggcgtacagctccaccgcgcgtataaactcgtcaacgatcacgtattcattggcgcgatggccgttgcggatgtcgcccgggccgaggatcaccgtgttcatccctccgatattggccagcagccgcgcgtcggcgccggtcgcaaaaccttcataggcgccggcgcctccaagctccgtaagggtgcgcagcaggcttttgagaaacgattgctccccgccgctctcatatggacgcacatgatgcagccattccaggacgggcggatgctcccgcagccacggggactgcgaagcgtccgtcagcacggcggtaaattcttcaatacatctgtcatatcccggaagatatgtaaagtttccttccagcacgcacgcatccgggatacagacggcacccgttccgcaccggatcacattgatgctgcaagcaggatgatgaaacagcggatttttctgcttttggagccaccttcgttccatttcatagaagccgtgaataaagggcaacgcctcctcaaaggcattgacgccctcccacttgatgttgctgtgcgcggcgcggcctttaaaggtgatcctgaacgccacagagccaacatgcgcgcgcatcggccgcagcgaggtcggttcgccgacaagcgcggccggcgccgtatagccgcggtcgattgctgccagcgtaccgttgccgccgcccgcttcctcgtcgcagacgctttcaagaatgatattcttttgaaagcgcacgccaagcccgcacagcacctccatcgccagcgtcatggcgcacagccccgccttcatatcgcaggcgccaagtccatacagctttccgtcccggatttcgcagcgaagcgggtccgacttccacgcgtccgggtcattgggaaagacggtatccatgtggccgttgagcaacaggccgttttcgtcctgttcgccagaaaatacggccacaaggttgccgcgcgacgcgtagctgtgtcccacgttaaaatcctcgtacctgcacaggcgcgccgggtcgggcgaaaaatagtcgagcctgcatggcaggcgttccagccgccgccttaaaaccgcctgcccctggtcctccttttcatcggtcgtttcggtgtcgatcagctccatcaaaaagccgatgtacgcctgcctgtttttttccaccgtttcatgaatccgcccgcgcagcatcatgtatccgcctccttttgttcccgcgtctcccgcagcagcgactcgcgggacttcatcaccgcgctgcggcgcgtcagcgcgccgcgcaccttgtcgatcaggattgcaaggatcacaaccgtgccggtgatgacctgcatcagataggagttgacatttagcaggctcaggccgttattaaggacgcccaggatcgccgaaccgagaatcgttcccaggatggtgcccgaaccgccgctcatcgccgcgccgccgatgatgacggccgcgatcgcgtccagctcgttgccctggcccatggtcggcagggcggatccgacgcgcgaagtctgcaggatcgcggcgagcgcgcagatcagcccgctgaggatatacacccacgcgttgacgcgcacaaccttgacgccggaaaacagcgccgcgtcccggttgccgcctacagcatagacatggcgtccaaacgaagtgtaccgcagcgtcacatgcgccgccgcagcgacggccagcagcacgatggtcggaattggaacgcccagaaagtaaccctgaccgaactggataaattcccgcggcagatcatagatcggatagccgcccgtgtagagaaagccgaggccgcgcagaattgtcattgtcccaagcgtcgtaataaatggactcatatcaaggcgcgcgataaacacgctgttgaccagccctaccaggccgccgatggcgatggtcagcagacaggccgccgccatcggcacgccgtttgccatcatggccgccgcacagatgcccgcaaacgcgatgatcgaaccgaccgacaggtcgatgccgccggtgatgataacaaaggtcattgcgatggaaacaagcgaaatgacagccatctggcgggtgacattgagcaggttggccattgtaaaaaatttcggggcggccagtgaaaagatcaggcagagcgccgcaagcgccagcaggacgcccatttcctttgctttaaacatcgatttgagcttattcatccgcatcgtcccccatcgcatagagcagtaaatttttctcatccgcctgcgcgcgcccaagctcccgcacaatccgtccgccgcggatcacatagatgcggctgcaaatttccaggatttcggtcagatcggacgaagcgaccagcacggctgcgccttcatcggccagcccctggatcaggcggtagatttccgtgcgcgccgccacatcgatgccgaccgtcggctcgtcgagcagaaacacgcgcgccccgcggcctatacaccgggataaaacaattttctgctggttgccgccgctgagcgtgttgacgggcgttgcagcgcccggtgtcttgatccgcagtctttttataaattgcgcggcattttcccgttctttgccgccgccgagcagtccgagcgcgttggcaaacatccgctcatagcccagattgatgttctcctgcacggacaggcccagtacaagcccctgcccgcgccggtcctccggcaccagcaccatgccggccgcgatgctcccggcgatgtccatcccgtccagcggcgccccgtccacggatacgcgccctcccagcctccggtcaaggccgcaggccgcaagcaggcactccgtttttcccgcgccgttcaggccgtaaagccccacgatctccccttttcgcgcatacaggctggcatgacggatcccttttggcgagcacagatcctcaatttgcaggcgcaccgggctttgagccggcggttcgcgcggcatggtgcgttcaaccgtgcgccccaccatcatgccgacaacctgttcctgcgtgagcgcggcagcgtcgcgcgtggcgatatgacggccgtcccgcaggacgatcaccttgtcgctgacgcgcagcacctcctccagatagtgggagatgtaaaggatggtcacgccctcgcgcttgagccgcccgacgacttcaaacagcttttcaacctccgtgcgcgtcagcgacgctgtcggctcgtcaaacatcacgattttcgggtcggccgacaatatccgtgcgaggctcaccatttggcacgccgcaatattcaggcgctccatgcatgtatcaggcggtacatgcagccccacgcgttccaacagagccgccgtctgttcgtagatctgccggtaccgcacgaacggcccgccctgcgacagcctgtttaaaaaaatattttccgcaatcgacaggttcggcaggattttgatatcctgatgcataacatggataccggctgcctgtgaatcctgcgggcttaaaaagcgcgtttcacgcccctccagctcgattgtaccgctgtcggccgtatacaagccggataaaattttaatcagcgtggattttcccgcgccgttttccccgaccaggccgtaaacaagcccctgttcaagctccaggctgacatcctttaaggccacaacaccggggaatgccttgaccagacggtcaatttttaaaatagaaggcatccgtttttctcctcccactgcgctcaaacggcctgcgggcggcaatcgccccgcaggaaccgggatatcaggcgttgccggccgtcacaagctccaccggaaccggaatgtttttttccacctgctcgccagcgatcaccttgagcattgtctccatcgtcgttttgccaagttccacgggattctgcgcgacgctcgccttgagcgcggagccttccttgatgtacttgacggcctcctccgtcgcgtcgaagccgacgatcacaatatcgtcgcgctgtgcggcctgcaccgcctgcagcgcgcccagccccatcatgtcgttgaccgcgaacacgccctgtacatccggatttgactgcaaaatattctccatcacggaaagtcccttctcccgctttgattcgccgctctgcacggcgacaatctcaatatcgggatatttctgcgccattgtgtcggtaaagcccgtttcacgttcgatcagcgatgtgatcgtcgggttgttaatcagcgcgaccttgccagttccgccgagctgctcgccgatgaactgcgccgcgagctgtccgccgagcgtattgtcggacgcgatgtggcttgcgacatcgccgcccgcgaccgcgatatcggttgtgacaagcgggatgcccgcctgattgatcgtctccgcctcggtcacggctgcgtttgaatcaatcggacagaggacaattccgtccaccccctgcgtaataaagtcctccacctgttttgtctgcgctgccaggtcgccgttgggatcctgcgtgatcagcttgacgccctgcgcgtcggcgacctcctgcatccccttttccaaatcgacgtagaattcaaagctgcggctccagttggaaaatccgaccacaatctgctccctctgcggcgcggacgctgcatccgctgcgggcgctgcggacgcctgcggctgcgtatctccgccctgcgcctgaccgctggagcagccaaacagtgaagccgtcattcccacagcgcacagcgccgccaacagcatgttcgcttttttcatcacaagttcctccttcatcgatgcagtctatcgttatgaaacggaccgtttcccgcttccaagccattcggccgcctgccgccaaaacagcgcgtagcccggccactccaaaaattccggcggcgcccaatgcggcgcgcaatcggtcgcaaaggccatcgtgcggccgcgttcataaacgccggccgcgacaaggatatcccctgcgcagcggaccaatatctcgccgccctccttcggcagcaggcggttatagcccagcactgcaggccaggcatcccctgtcccctcgacaatcggatgcgccttcacaacccgtgggacactcccttcgggcagctcgacgcggtcgtcggtcctttgcagcgagaccggcaggatctgttcgatgggcgtgccggcatagcccgccttgccgccgatgccctgaaacgacatgtacccgccgatcatcgcaaagccgccgcccgccgcgacaaaacgccggatgctttccagcgcgttcggccgcgtccgggaatcgaccatcgtcggtgtggacagcacaagcgtattgcttccaacgtcgctgcaaatgaccacgtcatactgcgttagctgctgttcatccggaaacgcgtcgatcgcctgatgcgccggcaggtgcgtcacttcatgtccgccgctttccaacgccttcttgatccatccgacgccgcacccgaagccggactgttcaaaggaatcaacacctttgatatggaccgtgtgcgtaatccatgtttccccgataaatagaaccctcattcctcgctcctccttcattgataaaacgttttctcagcgatagaaaggcgctgaccgcccagaaaatgttacttgctttcgtccgaaaccgctgacacagagtcgcgttcaaccagttttacaggcaacacaatctttttccggctttcacgccttccctgcggcgtcatcctgttctccagcatagccaccgcctgatgtcccatctcaatggtcggacgtgagacaaccgtgaccttcggcgacgcatagtgcgcgagcagatgatcgtcaaacccgatcagcgaatagtccgcacctattttgaccgcgtggccggaacaatatttcagcacgccgatgcagatattgcagtttgcggcgaacagcgccgtaggcggctgctttaaggcgctgaaatgctccaccgcccgctgtccggtcgcctcgtgccaatccccaaaatagacataatcccgattctctgcgattttgaagtcacgcagcgcctgtgcgtaaccaagataccgctcctttccaacattgatgtcaagcccggcggaaatgaagccgatacggcggtgccccttaccgatcagataacgcgtggccgcataagcgccgttataattgtcgatcacaatgctgtcaatcccggcgtcgtcgaccagacggtcgacaaatacaatgggtttgtcaaaggcagcgtaaatctggcggtcgttgaccgaaggaattgcaactacgccgtcgacgagctttccaatccgtccgtacagcaggccatattcgttttcacgcttggcatccgtattcacaatgattgtagaaagaccgatttcccgcgcggcttcctcgaccccttgaatcacctgcgcataaaaatccgttataatatccggtaccattacggcaatcaggttcgattttttgacgaccattgagacagcaatgctgttaggcgtgtaattgagctgctcggccaccttgcggacgtgttcgattgtctgtgtgccgacgcggcccttttgattgagcaccttcgaaacggttgaaatggaaacgcctgcttcgcgcgctacgtctcggattgtggcttccctcatgtctctcccccgttatcaaatgataaaacgttttctctattatagttcgacattgatctcccgtcaagtaatttatcacttttattcacaattttgtcttaattgtatctttatcaatattatttttgtttgttttaacaataattatttgaaaaaacgttatttcaaatactgcattactggcaacagcaagggccgtggatgccccatttcaagtccttgctatcatgtttatccggccaacctcttgcacacgccgcatggcctggcaccctccaatgtgtacaacggcgcaccgcacgtcggccatcaggaacaggaagaagcgggtaagccttgttctttctgcggtaagccgttcgaccgcttttcctgtgtgctgcacacgcaaaaaaggacgcgccgcagcgcgccctttcagggaaccgggattattctggcctgttctgttatgtatccttcccggcggccgcctcggcctttgtcgtgggcaggaggcgattatcctcgccgatgcgcagggccggggcgtaagcaagctcccagacatagccgtccggatccatgatgaaaccggagtatccgggttttccgtcccagtccttccagacgggtttctgctgcacagacgcgcccgcggcgacagcccgctcaaagatcgcgtccacctcggccgcgatcccaaaaaagaccggcgcaatttgctccaaaaggtgggcgttcaatttcaagagggagattatcagccggaaatcaaagtttcgaaactatgcgaggaaacggcttgcctttacaagagccctgccgactagaaatcgctgtgtgaataatttggcattggggacaaggtgaaccgggcggtgaaaagtttattcggcggggaacgccagcggctttttattgttctgactttgatccccgatccccagcttgtctttcttgacgagctgacaaccgggcttgacgcaaaagcgaggcaggatgtctggaaaatccttgaggggcttaaacacatcgggctgaccatttttctgacttcgcacttcatggacgaggttgaggccctgtgtgatgaaatctgcatcctcaaaaacggcagagctgttttctacgggacggtagcccaagcaaaagaacaatgtagctgcgaaaaatttgaggacacctatctggtgctttccggcgaggagggaacggacgaatgaatacctttggaacgcttttgaaaaatgagttgaggctcaacatacgaaatatgaatatggtgattttcgccatcatcatgccgctgatggtcttggtcatcctcggctttctctacggcacaaagccctctgccgacggcgcggcatacacctttttggatcagtcctttggtgcgctctgtaccatttcaatctgcgcgggcggcttgatgggcctgcctctgctggtggcagaatatcgggagcgcaaaatcttgaaacgctttcaagtgaccccggttagtcccgttatgctgttggctgtggagttcacgatctatgtgatatacgccgccctctccatgctgaccctgctccccgcgacaaggttatttgggaatgtcaccattcatggctcttggctagcgttttttggtagttggctgctgactatggtgtccaccttgagcattggaatgatggtgggcggtattgcgaaaaacgaaaagatggctagtgtgattgcctgtgcgctctacttccccatgctgattttctccggcgcgacattaccgtttgaagtcatgcccgaaatgatgcagaaaatcatccgtgtactccctatgacccagggcatccagctcatgaaagaaacttcccttggcttgccggccggcaacgtctggcttcctatcgtcgtgatgggagctgtgacagttttctgtactggaattgcggtgaaatgttttaagtgggagtaacccccatttttcatagggactatacgctataacgcccaaaactgccgcacgacggcaaaagaaaaaagccgtcgtacagcagatatatcttcacgtctgcttgacggcggcataagggaggatgccgcatgttacagtttagttcctaacaaactttaccgcctaaaaaaggccgttctttgcatgggatcagtccgccagtaaacatgaaacatatcactacttaatagattgtttcgtttcgtgcgtccgcatagctattcgctatacgggcgttttttgtccccgcttctggccaacgtggccagaggttcggagcactcccctgggtgccgctctctgccgccctccatttcgatctgcccatccgtcaactgcccaacatcgaaatggaggatttacaaatgaccatgttcaatctgcgggacgtgtacccgcttaaccatagtgacctgttcgaggaaaaggaggagatcgaggccctgtatgctgcctttgccgctctcccagaaaaacatggccaccgagtgtatgcccattacatactcggcgtgagcaaggcgaagattgcgcgggccgaggaggtggcggagagcgccgtccgggacagcatcagtcggggcttgaagttgctccgggaacttttgaaaaaatccatctaatcgcctgcggtttaaccctgaaaaagacacggtaaatagaaagaggtacaagccctttctttggaaccgagacgactgaatagacagcatttcaggcacaaaacccgcgtgagtgtagcgacgaaaggagtgccgccaagacagccagcttcaggaggtggcggacaagctggccgagcgatcaacgcaaacctctgacccggtgttgacatatcgggcgcgataacagcgcgggggataatgaaacttgctcacgccctcccacagacttgagagggagcccctgctttgcgccaggcccctccggagggcagcggtacggcagaggctatgacagccggatccaccggcggcctgaaaggttccccatgccggggatgcgtggcaaatatggcgcagatatagtaatcaagggggcgccctctccggtgcctttctgtcttgcgacaggccaaacttccccggatcggcggcctctgccttatcccttcagcttctggtcatccttcccccacgggacacagggaggctaataggcgatccacccacgcaacgaaaggaggccgaatgtctcgtaactgcaaggaagaatattgctatcagatagacaagatcacgtttgtggttgggccggtatacagcgacgagggcgagacactggccgcaatcctattaaagctcatgcaggcggacgcggagcggctttgaatttcggaggcatccttttcattggtagtcggcagaggcataatatgagtgtaaatactgcttgcttgactgccggaaaggaggacattttgaaacagtcaagcatcaaaaaacactctatcaataccgccgccctctactgtcgcttgagccgtgacgataatgtggataacgagtccaacagcatcaccaatcaaaaggcgcttttgaaaaaggtggcaaaggagaaaggttacaccgacaccctgttttttgtggacgatgggatcacaggcaccacccttggccgtcccggcttcaatgagatgatcaaggcaatcgagaggcgggctacatctccgccgtgtttgtgaaagacctgtcccgtctgggccgcgattatctgaaagtgggctactacacggattccttgttttattgaggaactccaacctccacatactgccgactttcagcattttccgttcaggcatccttcagttaggaggtagaaatcttctaccgctttatcggcaaaattgattaaatgacatcaatatctttaactatgtgataccgggcttgctccgcccgattcatctcccgttcttcctctgtattctccggctcctgatagaaccgttggtgcagggctctcgtgtaatcgttcatgcatgccgcctccttgtcagcaacacacaataccgcagaaggagaaaaccatccagcggcaggaggcagagttatcaaacaattcacatttcccgagggcttcacgctacggggaaaagtcttttctctttgttttgcggcgcagtttttgcgctcaccagtaatcatcttctgcttccatatcggcctctaactggagcggcaccttatgctttcgggcagtctccagggagatgtaccccttgctctcgttcacaagggccaccgctctggcccgcaggtcatgggtatcctgtttggaaagggcggtgatagaggccatcagcaggtgcgtctgcgcgatctccaccgcgattttataggacagcttggccaggtgctcctccaggtgcttgatctcgctccgctcgatcttctgatagaactgggacagttctccggtgaactccttcagaagatcgcggctgatgtactcccggatcgcggcgtcgatcagctcagaacggtttttgaagccgaacttctcccagttttgatccgccagacgaatgacctccgggggaagggacacggtgatcttctcagttttcttctccattttcatcctcctccggctccagaccgccccgctgataggcgtagatcctgtcgtagcggatactgcctgttgtccgctttacggctttaacacaggtcttccgcagctcctccagtgtctccttcggttcgcccaggcactggctggcgaacatgtgacaggccatctcctgctccacgcacatccgaaaaagctggcggcagatgcggttctccagcctgcccagctgttcctccaggaacgcgagggtagtcttgttcatataaagctcactgctaccttgctggaggaaaccaatataaaactccaccgccttgcagacaaagtcgctccggctggcgtgtccgtgcagtgggtagagggcatcgatctccgccacctggctgggcggcatcaaaatccccacccgctcttttttctcctgactcatttgcgatacctccttcaaatccataggggatggcccggaaatccccgcaatacgggcattttctgcttattggacggcccaagcagtctacgcctcctctcacacagccacaagtttagccgcgtcaaatcccgcaatcccttgtcccgccccgcgttgcggggcggtgtggcccggccggggatgcttgccatgcccggcctttatcctgcaccaaaatcacccccccggttcaccttttggcgcaggcgagatcctccgataacctctcttatcaaattcccgccacacggccgaaatacggtgctctcctgcttgcgggtacacggatgcttccccggcctccaaaaggccacacagcggcccacaggcggtcacgcggggttttcctgtttttgcaggagtttcgctacccgctgacgctccgcggccagatccagttgcgccagctggctggcatagtggtcatcgattacctccccgatgggccggagggtgaacagcaaatttccgttgcgccggccgctggacttggtaatgacctcggtgggctcggtagtgatgagttcccgctcctccagacggcggatgtacttgcgcaccgtgttctcgctcatgcctaccgcctcaccgatggtgcggatgctgggccagcactgatgggtctttcggttctcacaccgtttcaggaaactgtagactgccagttctccatagtccagccccagctggaacaattcgttggggagaaagaaaccatttttgtgttcgccgtacttcatgtgccgcctcccgtgtgctcgttcacccactggatgaactgctccttgggcaccaccatgcggttcccgacacgcagcaccgggaagcccggctcgtgcatcagttcgtaaccgctggacggtgacacgccaagcacttttgccactgtctctgcgttgagaaacagcggcaggtcgtcgtagcttttgtaactggattccttcacggtattttcacctcctactactttagccgaggacactttctgtgtgacatagaattgacacaaatgtatctcttttgccccctcactatgtattggggaaataatatccttttgacatacttctgacagaaaaacagagcgcctgcttggtcagcagacgctccgctcagcgttgggtcgattcagttttgcgctggtttccgcaggcggcattttccctccgcctcgtcccgctctttcagcagacgagccagggaagagaaaaatttcttttgccggtagtccacgctgccccggttgagctggtgggcctcggcgtacttgcggatggacaggccctccacgaaccgctcctggaagtagtcccggtattccgacagcactgttttcagggcgttgtccagaaactgcagatcctcttccagcttggcaaagtcacccctggtgatggcggcgaaccgcttctctttcacgcagaggcggtatttgctccggtcgaagttgtagttctcacagagttctttcgcgtatgcgtggtaggtggcggcctgctggtactcgcgggagtcgtattcttcgtccggctgccgccggtgccgtttgcgcaccggcccccggaagccttcatcttccagcctctcaatggcggcctctgagattttcatgttcatcagccgtttgtacttagccttccgctccccgttcacttccacaaaagcacagaaggactttttgctggaggtatagtacctggggacatccgcgaaagggtaggcagtccagatgacggtctcctcgccggtgtcagcatccgtggccgtggaaatcagatagaccaccttgccatcgtaccgccggtagtacccggcgcagatccgcctgcccgccattgccgtacctccatcttgtttttctgcattcagtatagcggagcaggggccttctgtaaatggcggaaggcttttctttgttttatttcccccgcaaaaactgagcagtgggtttccctgagtccactcatgtttcccatagacaggccgctcttatttcccaatcagccagtccggcaggccatagtcctcgttcagataggccaaacccggcacatcgaagtggtcggccccctccagaaccgtcacggcgacattgccgccggtcacctccaactgctgggcaaactccaggctgtactccggttctatgatagtgtccgccgagccaacaaaggcccatacctctgtctgggacagcgccgcgaggttttcttcggtggggaagaccgcgccgctgagaggggcgacccgggagaagaaccccgggaaggcggcggccagttcccaggccccggaaccgcccaggctgtgcccggtcaggctgatgcttgcagggtcaatttgaaactgcgtcgccaattcggacaccagggcatagacagtatccacccgatccgaccagcgtccggcggtgagttgcggcataacgatgtaggcggggacgtccctcagtaaaccgtcccggagatatttgggaaagccgccgtccatcaccagctccagatcggcgccccgtccggtcccgccgtggagatagaggagcatcggcatcccaggggccgcgttttccggcgtatagagccagtaggacagggtgcttccgtccgacgcctggaaggtgttctcggtcagcgtcgcggcgggagcggcatcgtccctcaccagcacgatctcctggcccatatccaccagtagccggccctccgcctggaactccatcgccttttccagatcgaaggcggggtctgcgggggatgcctttgtgtggtacgggatgctgtgtgccgcccccaccagcgccgcgcattgggaagcctctgccgtgtccatattgaaggccccgtcgcaacagaagaaagcgtagtcgatgccccacgatgccatctcaggcatctgctctgtggtggaggtgtcgccgctgacatagacggagacaccgtcgctgagggtaatgacatagcccacgcactccgtcacatcatggttgtcgttgtagccggcctccaccgcctgcacggtggcatagcccagatcaaaggtctgatgcaccccgtccgccagcgcctcgtcctgggtgatgatccggcagtcctcactgcggagggcgactttcgcaaccttgttgtggtctgggtcgtcgtgggtcaccaggatcaggtcggcaggcaggtcgtaccctgtcccggcataggggtcgatgtagatcaccttgccctcggaggtgacgatgcggatgctgccctggccctggtagagaagccgcgcctgcgctgtcgcccccaggcccaggctgttgcagaccaggatggccatgtcgccccgggtgagaggggcagctccctgttgttccgtcacctgttccaggaggcccagaccggtcccgatctccagatagccctggggataaccgcccaggttttcagcctccgtgccgtagcctcgggcgcggaccagcatggtcacacactgctccagagtcacatcgctgtccggctcaaagagggtgtcgctgacgccgtagatcaggcccagggcggaagcggaggcgatgtaggagtaagcccaatggctctccggcacatcttcaaaggtttttccttcgcccgccgcctcctggccgtaggcccggaccaggatagtggccatctgtgcccgggtcagcgtcgcctccgggtcgaaggtgtgggcggtagtccccgccacaatgccagcctcgtacagcgcctccaccgctgtctcacagggcagaccggcgatgtcgtcaaatcctgtttccgcgccgttggcgcttgcgccgggcagtagcatcactgccagcgccagcacggtcatcaaactgagaatctgtttcatccaagggaaacctcctttttctgtggctgttttccagtgtagcatggggccctgcggcacttcgagggtcaaactgcggcaatcctgcggcagaccttttccagcctgcggagccgtgatatgatgcaggtgtgcagcggcggagcggggagagcgcggctttgtcccgtcccgctccgaaacacagaaaaaccccaaaaaggaggaacctgacgatgaaaaaaatcattgcgctgatcgcggcggcaagcatggcgctgtgcctgatcccggcggccgctctgtgcgcggcggccagcgatggcgagacgacggcatacgaaaccagcccggtccgtgtggcgtcgctggcgctggaggaagctgctgacgatggcatgaatatgtatgagaacagcgacttcatcgaaaaggagcagccggagctgagcgaggagaccaaggaactgatctccctctaccagcgtgatcccacggaggaaaactacttcaacctccgggagaaggtgatcgaggactataacgcggtggtggagcgcaaggagaccaaactcagcgaactgaaaacggagaccgcgggcaagcccggcggcgaggacatcgtggccgaaatggaggatctggtacaggagatctacatcacctactgggaccggatcaacagcagtatgctccgcttcaccgacccccgcctcttggagtggcgggtggccggcgccgcacggtatgactacatccccgtgatgggagccggggagagcatctacatcaagcgcactccggtcaccaacggagagtacgcggagtatgtggaggccaccggcgcggcagtcccctccaactgggtaaacgggacctatccggccggcgagcgggacttcccggtgaacttcgtctcctatgaggacgcccttggctactgcgcctggctcacggaggaggacggggtgaatacctaccgcctgcccaatgagagcgagtgggagctggcggcgggccatatgcccaaggacgctgatttcaactgcggcgtcaacgacggcagaacgccggtggatgaatattccgatgtgacccggggcgcccacggggccgtggacttctggggcaacgtgtgggagtggacctccaccgtccgctcggaggaggacggcgtcacgatccttggcgtcaagggcggctcctggaaatcggagcggacggactgccgcaccgaataccgggacgagggccgggacgcctcccaggggtatgaggatgtgggcttccgtgtcatccaggtgctgaacggggaggagccggagcaaaaggtggagctgaccaccctgcccgcccctgtggtgtccgccgccgctctgtccgacgatgccatccagctcacctggcagtcggtggaggacgccgaggcgtatcagctttttgaatatgaccaggagaccggcctggtccgtatgctggaccgcaccagcgatacctcctacaccgtgtcgggcctgacgccggacaccgcatacagctacatcgtccagcccttctcctacaccgccattggggacaacgtatccgctgaataccgcgtcacggccacgacgctgtccgccggggaggctctgcccctggcctttgccgacgtggccccggacgcctggtatgccgatgcggtgcgatatgtgagcgaaaggggcctcatgtccggtaccggcgataccgccttcagccccgatgataccaccacccgggggatggtcgtgactattctctggcggctggatggctcaccagcctggacaacgacatctggattttccgatgtggaggagagcgcctactatgcagaggcagtaggctgggcttcggccaacggcattgtgggcgggtacgacaacgaaacatttggcccgggtgaccccatcacccgggagcagatggccgcgatcctgtaccgctttgcccagacccggggctgggacaccacggcctgggccgacctgtccggctatgcggacgccggggagatcagcgcctatgccctcccggccctccagtgggccaacggagcggggctcatcgccggcagtggtggggctatcttgccgggggattccgccacccgggcccaggttgccgccatcctcatgcgcttatgcgagaccttcgccgtgtaatgcttgcggggccggagagaattccggccccgctttttgctcccaacgatatggcagagtatgagacgtgctccacaaggatacctcccagggcaaattgcggcaaaactgcggcagacctttaccaaagcacagtcggatggtatgatacaaataaatcatgccgggggtgattccatgccgcaggtcatctatgtggccgacgatgaaaagaatatccgggagctcattgccgccttcctcacccaggagggctttcaggtacggaccttctccagcggggactccctgctcgccgcctgcggagaagccctgcccgacctggtggtgctggacatcatgatgcccgggacagacgggctgagcgtctgctcctctctgcggaaggccagtccccggctgcccatcatcattgtctccgccaaggacagcccctacgaccgggtcaccggcctcaccctgggcagcgacgactacctcatcaagccctttctccccctggagctggtggcccgggtcaaggccctgctgcgccgggcggggaacgagccccgtgtcccggaacccagccagcccctggagtacggtcccctggtgctgtccccggagctgcgcaccgccgctctggacggggagactctcaccctgacacccacggaatttgactttctggcctacctgatccagaaccgggaccgggcggtgagccgggaggaactgcttcaggccctgtggcaggtggactggcaggcggacacccgggcagcggacgacctggtgaagcggctgcgccgcaagctgcgggagcgggacagtcaggtgcggatcgagacggtctggggctacggcttccggctggtgcgggagggggaggaggaatgaaacagcagaccctgctctcccgcctgctcctgccggtgctggtggtgctgattctcctgccgcctctcagctgtctgatctttcagcaggcggcggcgcggtatgcctatggggaggccaccggggatttagcggacttgcaacagaatatcctgcccctgatggagaacagcttcgcggggcagacggacacgccggaggaggcctcggaacaggtggggaactttctccgtcaggcaggccctctggcccaccgcatgggcgggcgggccagcctgatgatattgggtcctgactttcggatggtctatccccgggacgagggggagcgggaggacgccgcccctctggcggaggcgtgggcccaggccatccaggctggggagttgtcctcgggggcagaggtcgcggagtggacagacgcctccggggagacctggctggtgcggatctatgaagtccccacccagtccgtgcgcctgcggtatctggtcacctactgctccgtctccaccatcagcgcctgggtcaatcagaccagtctgctggtgctggtgatctccggcctgttcgtcctggtggccatcggcgtcctgtgggtgacggcccggagcgtcagccgccccttgaaccggctgtgccaggaagcggagaagatcggcacgggggatttctctgaaattgcccccgccttctccctgcgggagctggagcagcttcgcgcctccatgaacgggatggcccgccagctccagcgcagcgaccaggtgcagaaggactttttccagaatgtctcccatgagttgcgcaatcccctcatgtccatcagcggctatgcccagggcattgagcagggggtgttccccgcgccaaaagaggccgcccacaccattctggaggagagcgtccggctgacccagctggtgaacagcctgctcaccctctcccggatggagagcggccagaatgtgccggcgctttccccggttctgctgggggaggccattggggactgcctggaccgttttcacggcctggcgctgcaaaagggcgtcaccctcgccgccccggcggtggacggggccctggccgtcctgggggacgaggagttgctgggaaaggtactggacaacctggtgagcaacgccgtccgctacgcaaaaaccgccgtcactgtggctgtggcggcgggggaaaactctgtccaaatctctgttctggatgacggggcgggaatcagggaaagcgatctaccccacctgttcgagcggtgctacaaggggccggggggcaacttcggcctggggctgtccatcgcccagaccgccgccagggccatgggcgggaccctggccgccgccaaccgtccggaggggggcgcggctttcacactgacgctgcccagggcagacgcccatgaagcaaaggaatcctgaatatgaattttcgcgactactatctgtgggcgggccttgtcctcttatgcctggatctgtaccattttctccggcagcggaagggctatgaccgcaacacgatcttctttttgcagctgagttttttgtccatcgtggtctgcgtcctgggaatcctgatcaccgccgcccaaaatcagctgctccccctggggcactggccggtgatgcttctggctaccggcctgtacctgatccagacggcattgccctacaccctgcttcggttcaccgccacccggctggggcatgacagggaccggcaaaagcgtgtggatcgctggggacttctggcactgcttcccggtatggcgctgattttgctgaacctcccctttgacttgatctcccgggtttcggaggacggcttcctgcgggtctgctccctggctccgttgtataccggtgggatgctgctttactacctgttcgatatggcctatatctggacgcatcggcgggagctggggcggcggaattggaacgcgctgacggaaacctgcgccattttcatcgctgggctgatcgcccaacactacctccatatccagctgtttttcggctttgccgcggctctggcggtgttcatcctccacctgacgctgaaaaatccctatgcctacattgacatcacgacccatgtgttcaacgcagagtatttccagacctggatggccgagagattggaaatggacgagaaaggcattttgattgtcctggatttctatcagctgggccgcgccgtccgcctctatatggatgggactggctcccgattggcggtgctggcggcggaatttctgtggtcgctggaagagaggcggcctcatgtattccggctgacgcccagccggttcgtcctctggacggattctgacgccaaggcggaggagctcctccggcggtgtatggaacgtctggaaaagcccttttcggcgtaccgtcattccatccgttgtccggctgtgctggtaaaactgccgctggacgggaccttttccagtgtttcagaactgacagcttacctgggattctgcacctgtctggctgacggccaagggacggtacaggtcatccgggacagcccatcgctgcgggaacgatttgcgggtgaggcagagatcgagcggttcctcatggaggcattggaacaggatctgttccaggtgtggtatcagcccgtctattctctgaaagagaaacgttttgtttcactggaggtgctcagccgcctttatcatccgaaactggggtggatctctccagagcggttcatccaaatcgccgccaatgccggactgctctcccagatcatgctccagcagctgaggaaggtttgtcgatttgccaaggaccatgcggagctgttttccggcttggagagcatcaagctcaacctatccccccaggagctctctgagccggactactgtgagaatctcctcactatcatccgggaatctgaactctcgccttctaaatttcagtttgaagtgaccgagagcacagccacccaatactcccttgagctggaagcctgcatctggaagctccaggaggccggggtcggcttatgcctggacgattttggctccggctacgccaatttgaacacggtgctgcgcctgcccttctcggtcatcaagctggaccgctccctgctcatggggatctgccaagacgaggcggctgctgtcttctaccggggattggtcaagctcctgaaaaatctgggctatacggtgatcgcggagggcgtggagacagagcaggaggcagggcttcttgctcagtgggatgtggagcagatccaaggttactacttctcccgtccgctgccgcccgagcagttggcagaattctggaatggcaggccggtcccggagctgtcgagtgaatccagaaggcattcccatgataatttcgatccgaaaggggttattttatgaccagggtaacgattcgctgcggaggcgaacagttttctgccgttttggaggaagaacgtgcccccaaaacctgcgccattttcaagaagatgcttccaatcgaaacacagatgattcatgtccgctggagcggagagggaatgtggattcctatgggagatacacgctgggagggacttgactatgagaatcacaccagttatcccagcaaaggtgaaatgctgatctaccccggcgggatcagtgaaatggagatgatcctggcgtatggcagcgttcattttgccagtaaggtgggacaactggcaggcaatcatttcctcaccattacagaggggttagaccgtctatatgctttggggcgcaaatgcctgtacgaaggggcgcagtccgtcctgattgaactgctaccgggtgacgcctgataaggctgtggatttttcttgtttattgtttatagccctccaatttctgaggcgtggacagcgcagaaaaggcttgctgaatcccgccctcagagttacaatgcaggtagtcagaggcatgaaaatgctcccagcccaagccgggaaaccgtttccggcaaaggacagggagcgtttttgaccacattttcagccacagtgcggtgtggagcacatggaaacggtggctttagagagtgacggaaagcaagcagaatagagcggaaataacacaaaacgagtaaaaattatgcaaaaaatcttttcccacttctttgtttaggcgtgctaaaaaatgatacgcctaagagtcagaaatgacttgctttcaggcttcgccagaggtacaataccccaaacccaaacagcaaaaagagcccttctggacaggcggcggcagcgaatgccgcgcctggtcaagaagggctctttgaccacatgtttgatcacagacagcgccggagcactcggaaacagtggaattaagagcgacaaagagtgagtgaaatgtagcaaaaatgattaaaaaccattagaaagcaccagaaaaaatttagttcaaccgtttgggaccaagatgccgcgggttcgaatcctgtcacctcgaccaaattagacaaaacccatgtataacatcgttatatatgggttttgttatttttatggtgaaaggcacaaaataaatgcacttcaattgtgcaaaacaacaggacaacttaaatacaaataaaaataaggtttcatattcctatgttttacctccgttagcagctccacgattaaattattggcctttttgtaagctgtgtatgtgccagtctccgggcattgcagaggataaaatgcagtattcgaatcccacgacagagtatcgatatttaacaccttggacaggttggccccggacagattggctccggacaggtcagccccggacaggtcagccccggacaggtcagcctttacgccctccggttcaccccggagccatgctgcgtgcttgtcaaggatatctttgatattcatttgatttctcgctccttttttcaacccacatatcttgcgcgcctcatgatttggcaacctccaattcgattctcagctttgcaatctcaatcgcatgacggtatgcccgcgcgtgctcattgtctccatgcgtctttgtaaccgcggctgcaaattcgtcgattgtaccataaaagcatccgcatgctacactgatgccgttgtctgcgttgcggaaaaatgttgtcgtgccgttacgcgaaccaatacaggatatccaatatatgtcccgcgggcctttgactagcgcattgccgccgacccacgcattgccgccgacccacgcattgccgctgaccaatgcattgccgccgacccacgcattgccgccgacccacgcattgccgccgaccaatgcattgccgccgacccacgcattgccgccgacccatgcattgccgccgacccacgcattgccgctgacccgcgcattgccaccgacccacgcattctcatcatgacttaaattgcgttcatcctctataaatcctcctaaatcaccagcatgtacattagaaaagtcccttgtggccctaatgcggtgcagtgtcttgccaaatacgttgatggtttcccctgtaagctcgtattttttcatttgacacaatcctttaccttaagttctctgctctatacggcactccaatatagtcaagtacgcgcccccaaccaaacggttctccagtctccgaatcgacagcgcagcgatacatccaaaaatcccattcagccgggttttcttcacgaagccggtcaaaacgatgcggccgcttttcaagatggattccaaacccgcacatgctgcatccggttcgctgcgcctttgtcgtgcgcagcgtcccatcctcatctctcacaattccgccgtagatttctggcactggagcatttagatcaagcgcaatctgcaataaatcctgacggccaaaaattgcaaatggacaactgcgtgtaactgttttgccataataattgcatccatgcatcatcaatgatttttgccgccgtccaccttccgaggccatcagtcctaaatagggcacgctgttatgcttgcgcgcataatcgtcacaaggcttttccttcaagtaataacaacacttgtccgatactttaaaaggcgcgatctgataattgacgccctcgttctcgttttcatatcctccaaacaattcaagccacttttgaggcatcttcatacgtgtgcctgtgcggttcccgccatagtctcctgtttcacctgtgataatggcatgccggactgtggcgtttctgtcactgggacgctggagcaaatcgatctttcccgcgatctcctttgataaaacagggaatccaaattcacggattacttccactttgctttttaatggctttaacggtatgacgcccaggcttttatgtatcttttggatgcttttatcctccagacatgataccgagacagccggtatatccttcaaaccaattgatctcaaaaagataagcaaagtaatgctgtccagaccgcccaccgaaacatggacgttctgcccgcgtccagtaatttcccgataatattcttttgcccggcgttccgcaagaattaccttttgttcatatggtagctgctgcttaattcggaaagccgatatttttgacgccgtaccttccgcttcatatcgttcaatgcaattcataatatccctcttgactttttacgcagcattgcgtaaaatttagatgaaacatttttcttatgcgcctcgcgggatgccagtcctgcggggcttttttgtcatatccatacacaactgaatccccgcacgtatgtaccctgtttccgcgcctgcctgcgcgccaactccaaagcctccgcatagcttacgtttacacaataccgctcggttgttccgtctccgtagatcactttgattcgcctcatgttgtcatgctccttactactgtttgtgtttcccctctccgtcatccttcggccccatcagcctgaccatctccgcgaaggttatgccgtagtatgcctccataaaagcatccatgacatgctttgcattgagaaaacgccgctcgatttccgctttggtgctgctttcgcccaagtatccgccgtttgacataaaaatcctccttatccttgcatcaggccggaggatatggtaaaatttcctcaacagacctgattggttgcctcaatctggtttgccagccctcggggagtgccgctaacacttcccggaggcgaacctttaaatcaactgactgtaacagagaaatcctgtccctggtcttgcttgccgggggcggggtttttctctgccaaaaacaggtttacaaaatatacctgccccttaccggttactttcggggtcttgtttacgctgacatgtccgtccgaatgggtgattgcggtctctttgatctcaaacaggcccagttccatagccctttgcgtcggcatattgtagtccgaccctttccggcggatgagatatccgcgctccctcagcttcttaaacagcctgatctgcccggtgtccaccccattctgtttcaggagttttgccagctcgcctacaaggatggaatttttggacgcgctgacggaatttgcgaacagaacaagcggggcgtcctgtttgaccttttcctccagcccattgatttttcgctccgcaattcgcagcgcccgagccatgaccttttccgggctgttccaatcctcttcaagctggagaaaatattgccgcgcttgcttgcccttctcattgcgctgaatcatgcagatttctttcgccatgtcaatagtgagggctgcatcctcaaccggccgggaaaccatgcgattgccctccatctgaacccgctcaattttgagcaggttgaaatctgttccagttgtaaacccgtattcacacatcctggggaaccagtctttgtatgcggttttcacctccagaaactcgtgcagttcccgagccgacacggcggggcggtcacccgtgaaatccactttgattaattcgttcattttttgtcctcctttatctccgcctcctgaaagcggggggcgtctttttgctcgttcatcaactttaaaaccgaactgataaaatgcttcatttgcggttccttttccgccgggagttttgcaacagtgtccacttggtaaaccgcccgcagcagcgtcccgatggcatcccttaccttatgctgcatcttatgtccggcgttgaacccccatacgcttccatccgttcgggaaccagtgtgaatttcctcatagccaaatccggcaaaggcttcttgaaagtccttgcaggctctctggtatgccgtccggttttcctttttccgctgttcctcccgcgccaattcctgccgcagcatttccagcagttccgtcttgacctccggtgtaatcgtcatgctgtcctccttgcctttttgttcgtgtcgtgttatgctttacccaaagagtttggtgaagccctcatacgacctaataccaagaacatctgcaatccgaattgccgttcggacgtttggctcacttttcccatattcgatgttttggtattgagcttcactgatttccgcttctttggcgacctgtgcttgtgtcttgccagactgcttacgggccgcccttagttccatattcactttctcctctctttctggattgcctaatatattaggtgttattgtcattttaacacaccaaatatattaggtcaatacctctttgtaattttttagggggtataacactatggagttgcgtgaggcattaaaacgatcacggaaaggtgcaaaggcaacacagacgcaagccgcgcaagccgcgggagtgtctgtatctatgtatcagttttatgagtatgggagaaatgagccaaccgccagcgtcctcatcgccctcgcggacttctttgacgtgtccttagattacctctgcggccgcagtgacattgcggaaaggaggtgaggcatcatggcaatttacacaagcagcggagtaaaaatcgctgaaacttctggtaacgatattgttcttcccgaccccggagaagtccaagaactgcggcgcatagctgacattgccgcagaaaatgctgagtttgccaaaaaacaggcagaatccgctagggtagatgcttgcgtctctaaagtgttatctatcatctctactgcggttggtcttgggagcctttttgtcgctattcttgcgcttatgctgagataacgagaatacccatattgtgttacatatggccaagccaaatgtaaatgccgcaactgccaccgcaaaaactttaagccaatgtactgttatcatttttctcctttctggatggcctttccatccttagggatatggccgcaataagcttgggcagtgttattccataaaaggctgaactttgaatgctgtagagtgcaaggtcctcaataagtttgattcgatagctgcactaagttcgtctggaacagttgttgcctcatggcaactgataccgctttcctcaattagtttcagaatatcgggaatcagcttgttgcgaacaatttcggcgtgctcccccgaagtaagaaaggttccaaaacattcaattttcaatgttctcacctcgcttcataactaaaggaacttgaggatatagctgaacaagaggccgagaaaaaacgtcagcagcgatttgagaacaagatttctgtactgaatgtgcttgtaccggcgataactttcgtcctcggtcttcttgttgagcatttctccggtatcgttgagctggttatttccctgctgcgaaaatgacctttcaacatagcccagttcaatcagacgcgataacgcggccatatcttttgggttaattctgccacttctaagcgggcgtttacttatccttttcagcaaacggtattccttgtttgttaaatccaagatttttattagctcctttcgctgcccccacctgtctgccaacgggcaagggcgatttttttaacagcagccagatccgtcgccgtagccgtgaccgtcgccggaaccgtcgccgtagccggatccggagccgtagccgtcgtcggagccgtcgccagagctatagctgccgccggagccgtagccggagccgtaaccgtcgccggagccgtcgccagagctatagctgccgccggagccgtaaccgtcgccggagccgtcaccagagctatagccgtcgccggaactgtagccgtcgccggagcaggcattcattcttcccatatcggcacctcatcaatactgtttttcgctttcgtcgtaatcgggatgatttcaatcacttcggttaaaacgactttatcgacggggcaagggaatttacacgcatctggtttgctcgtcccgtctacggcaagctgcgataggcttgccgcgcctgcccagtaccaaatcctccgtgcgtttctcaatacagcttctttcccgttcctgctctcgacgtatccagcgaatacgcctgcggaatatgtccgcaccatgcaatactccattccatccagaacaggagccatactcgtaacgctatctttcggaatgtaagcaataccgctgattaagatttcatttaattttcctttttccatttttgcactcctcatattttgatctttgacacactcacaggggcgtttttatgcgcttcactgatctccggcaatcttattcagggggacttcaattcccgtatattcggtaaaccttttgggagaaatatagtaactccactttttcatcttaaccgcatatccaaacgggcaagtgccttgctttaagccatcttccacaaattctttggatttcttcatcaactttgccacaagaacaattgacaaattccctacttcgtcgttctgaaccgttgcagcgggcataaacgtttcaaagtagttttcctgtacccccaatgcccgggcaatctcctgtttgcgggctttggatggttcatgctggcccgaaagatactggctgatagagggtttaccgattccggtaaggcttgaaagtttagattgcgtcaaatttagatcgcccataaggtttcttaatttatccgcaaacctcataatcacttcatcctttttctttctctttggggtgctgtgcgttagtgtccctgcgaacggttgaccaccttgtttcaacgtgatatagtagaaataccatcccgaaggaggctgcgccatgaacaacgaagaaaagattttagcaatcctgcaacagatgcaaattgagcaacagaaaactaatgatcgtttgaataggctcgaggataagatgaatgcccgttttgataaagtggacgaacgtctggatttcctcgaaacctgcatcaacgaggccgcaaaggacacacagatgtccattcgccggcacgaaaaagagtatcatgaggccgtttgaacgcctttttgccgccttcgggcggctttttttatgccaggtgattatcggagaatccctctgtttccctctccatgctttccggttgccccccggccagcagccggagcagttcctcaaaggtcatgccatacgcggccttttcgagcgtgtctatctcacgcttgacgcgggacgcatcccgctttagctctctcactgtcaaatcagacattttgtcctccttcttgttgcggcttgaaggaggatgtgctataatcttcctgcaagcctgattggttcggtcaattaggtttgccgcctcgctgggtgcctccgacacccggcggggcatctttatttggttgtctcccctgttttcatgtggtaaaatgaccgcagaagggaggtgaaattatgcttcttccaccattcagcgaatttttgagcagtatagatcctgacaagctgagctatgatttaacctcattcagcgcgcccaacatgaaagagaactataatccgttcactcaggagcaatataagctgattgtcaaaacaaatttcgcgattatagaggctattttgacccaataccatcaatggcttgctgaacagcttgaagcatagtgtcaagtgggctttcagttgtgccgccatcatcaatttgcagcttctccatctcaagcaatttttccgaaagtctaatcatcgtttcggaaacgtgtgccagggattcttctgacgagcaagttatcgaacgctcggagagtagctgcaactgcttttcgagcgtttctttgatttcttgattcgtcacctctgtcacctccctgcaaaactgtcatcggtactgtcgctgccgtggcctcaatagtagctgctacggcaagcattatcgcttgtctttcttgacgccataccacctatatagcaaaatcatcagaatgatgttgcatacagccgccacagcactggcggctgttgttataatctgagccatcgtcacgcctcctttctgctcctatccgctttagccatccacaccgccgctggacggcttttgctttatccggccatccttttgcccctctggactaaaagcagcgttttgatctgatcgtatgtaagccccatgtccaacaggacagtcaagcgttcctcggccttgttgtaagcggacagctcgtccgacgtgagaaagtccgttgcgattgcttttgcagaggccccccgttctttccgaagtacccgggcgatcttccccgtcgcggctttataggccaagtctgtgtaggtgccgtaggcgtgtccgtgcatacggccatcttccccactatcccggatagcgtctgtcaatgtcctgcggatgggcttgcccgcgtcacggaaaatctggcggcgtgtaagctcctgtctcataataaaaaagcattgtaccagcttacgtttaaactctacaactatcggcgtatttttgaggagtgtcattaaaaaataagcttgttgctcgttaagcttataaataacctccggctgcccacgcccccgccttggaatatcggtcctatatggggccagtattccaaaggcctgcaacccttctttgtgtttaacaattgcggacttcaattttttatgtccgattcctgcaaactctgcaatcacctttgaggttgtgaacggctcagaacctagcttgttaggttctaggaacactagatcggtcatatccgtttccctcctacgctgtgcgatttactggcggcttgcggggcgtttcagatgtttcttgtgtcaggcaattccgtgtatgccgcattgccttagccatcatcaacagcaaatcttggctacctaccggaagtccgcttgcattgtcaatgagttcatccaaaatttttattttctgaacagtaatgttttgctctgtcaatgttaaactctcctttctttttgctctgtgaatgaattatagcacagcaatttaacattgtcaatgaattttaaaaattatttatgctttaataacgcattttgtcattgacaatgaatcaaaaatgaattatactgacgttgaggtggtgaaatgaatacattaggcgaaaggcttacctatgctcgaaaaagaaatggcttcacccaagattcccttgctgaatctatcggcgtctcgcgtggtgttatatttaatctcgaaaaaaacaagactgaaccacaaaccatcgtcatcaacgccatatgccaaattctaaagattaataaagagtggctaataagtggaactggcgaaatggaagatagcagtgaagcctcgcaaagtgctaagattttggccgaactttatgaagtggctaagagcctttcagaagatgaacagctttatttgctggacacggtaaaggcattgaagcagcgattaagcagagagccaaaataattgggctactacagcaaaggggctgtaccattcagcacggcccctttgtttgtgtagcggttaaactgccgaaccggcggcgtgtttttaagataggtgataagcaacgtcgcctgctgttcgttaaggcggtagagtttcgtgctctgccctgtacggctgcttggcaaaggtcggatttcaaatccgagcttcccaaattcctcaaggtccgttcgatgcgtcctgcacagatgctgtacagtatcatgctttacttgtgcgcaatcggcaatgatatccgatgtcgtaaaaggctctgaacctagcttgttaggttctaggaacactagatcggtcatatccgtctccctcctacgctgtgcgatttactggcggcttgcggggcttttcagatgtttcttgtgcgacctttacgcttttggcaatcagaataacaatgtctttgttcttttccgagagttcgctaaaaatagcctgcatatcagagcttctacttgccattgataaattcccctttctttttatctttaattgattttccggtataagaatacatcaactattgatttttgtcaatacgtttttgatatttttcttgacttttttatcatttattgatattatggttttggaggtgctgataatgaataagcgtatccgtgaattaagaaaaacacttgacctcagccaaaaggagtttgcagaaaaaataggtttgaagcaaaacgccataagccacatggaaaaaagtggttctactgtcacagaacagaatatcaagactatttgctcccaattcagtgtcaatgagaactggcttcggactggttctggaaagatgttcctcgaaaatgacaggaaacagaaagagttctttgatatatttgatgaactttctcccgttcttcaagattacctaatcaaaactgcaaaggatttgcttgatactcaatccaaaatgaaatcaaccgatacagatatctaattacagcaaaggggctgtaccattcagcacggcccctttgtttgtgtagcggttaaactgccgaaccggcggcgtgtttttaagataggtgataagcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcagcacggcccctttgtttgtgtagcggttaaactgccgaaccggcggcgtgtttttaagataggtgataagcaatgtcgcctgctgctcgttcagttggtagcttttttcaggttggccccgtcctttgatttcttcgattttaaatcgaagtattccgaattcctcaaaatctgttttgtgtttctgaataagcttcgttactgtatggtgccgaatatttgcacattccgcgaccacctttgaggttgtgaacggttccgaatccagcttgtcgggttctaggaacactagatcggtcatatccgtttccctcctacgctgtgcggtctatgggtgtatcgccctcctgctgttgcgcggccttgaaagccattccttcgccaaacgccagtagtttttctttttcaaaatcggtaagaactggtacgagtttcttaaacacatccagaatctcacgctctttgtctgacattttatccacctctttatgtgttgattctaaaactattatatgtttgtttaaaacaattgtcaagctatttttgtttttcaccgactttttgttgacaataaaacatcattatgctatgcttttatttggaaataaggaggtgacccacgctgaatgagcgtataaagcaaatccgccgtctcttggatttgacacaacaagaattcgcagacagaataaaggtaaaaagaaatacggttgcgacatatgaattggggcgcagtgagccaagtgacgcggctatctccttgatttgtaaagagtttaacgtaaatgagcggtggttacgtactggcgagggcgaaatattcttacaaatgacaagagacgaggaaattgcagctttcattggcggtgcgcttgctaaggaaacagattcctttaagggggttcacttagataaagataccacaccattcccacgctgacttttgctcaaccgatacagccggagggctggataacaagaaaaggcggtatgcgccccgtggaggggtagcgtaccgccttttcttgtgggggtttccaaagggggcaacgcccccatttggcacacgactttgcgaagcaaagtgtagtgtgttatacgctctgtcggcgttgccgtgaaaatgccgttgccgccggggagggcaagggcatttgaagcggcaggaaaacagggttgtgcttgtgtggcgtggagccgcaagcgcaggtctgttttcatcagcagacagggcgtatatgaaagcccccgtccctcgtcctacgctccgacttgtggacaaaatgtcccgaagttgtggccacactcccggaaaatcagcaagacaacgggcaaccgtcaaggctgaaatgaacggatttacacccggccttgaccgccacccgccgtcccgctgaatgagtggacaaggcggccaatcccgcaaagtgcttggccgctctctttctgattttggagcgtttttctctaaaaattgaaatgggcgggaagccattttagggctttcccgccttgattgcctatcagcaaagacagacgggactgtcaacggcggtgcatgaaatgcgccgttcatcttgaccgttgactggctcggatgtctttgctatccatttgtgttattgctcccagttgttttcttgaagtaaagaatataataatgttgaatagctgctgagtgtattttggacacgtccgctatattcattttcaataaaatccaaatcatccatatctgtatgcattatcaatccattcttttctgtttcgacaggagaaccattttcccagttgtttgcttcaaaatatatgtacggaattcctatgtcattaaacggtgcgtggtcgcttcttttttgacctgtaggatagggataatcgttatttccgtctggtggtaattgtatgttcaagccaatttccttaacaatttcgtaggctttaaatactgcttcggtattatcaacagtgccgttatcattcaccttaccgccatacaaataaaggtaatccccagcgaggacagtatcaatgtttatcatcaatataatattttctctttccttttcggaaagtgattcaacgtatgcccttgagccatacattcctggttcttctgaaccgaaaaatacatattgaatagtatagtatgttggagtgttgaccattcgcagggcattttccaaagcaacagatacgccggagccattgtcatctacaccatgtgttccagcactatcataatgtgcgccaacaataatcgttttttcgctttctccttttttggttatcaaaatattttgacttgaattacttttttcacctccatcgaatacattttgtatggcttcatccatcataggcgtggaatcatctatttcaaaagactctatagctatgtcgctttccgcatatccaccatttaagaggacggacaaaataaatacagccatttccgtttctttttcagtgccagcaacgcgccccggatagtttgattgaatatgttttaaaaaattatatgcgggtattccataatcattttgttcgggggttatcgaaatttcttgggaaagtgttaggtctttggcttcttcaatcagctctgtttttttactaccacacccatataaacccgtacataaaaaagcacatactaaaaagcatgaaagtatctttttcataaaatcaatctccttttttctcatcactatcttttgacatttgcgtcatcattttcttcgccagctgctggaataggtcggcagtttcttcgtccatcggcgcaagctgtccgatctgtccggttatcattgctgttacatcgtcaatggaaagcgggttttgcttctgctccgacagtgcgtcccgcatggcttggaacatagcggcggtcacagcttcccccggctgttctccgttatcaatgtctttcttaatgtcccgcaggatagcaaggaacacatttttgattttctcaatctctgcttcatgttcccccatcttctgggcgttcaaaaattgtaaatcctgctttgcttccgcccggtgttccgggtgttctttcatcaagtcggacagggaagccgttgccatctcgataagctggttacgtgccattatcccctttgccgccgtgtcctgaaaataaatccgtatcaaatctatcagcttgggaaaattcctgtgttccagtaagcgattgagtatttgcacatcaacagcacccgtcacaagccccctcacggctccctctgacaaacctaattcagaaatatcgtaacttttacggacgctcacggtggacaagcccagtatatagtctgtcgataccttaaattcctttgccactcctatgagaatatcactgctgaccgttctcgtttcgccgctgacaatgcggctcaactgggaagcggaaacgcctatcttctctgcaagttccttttgtgtgatatggttcccgttgcataaatcggaaatccgctgtccgggtgttccgggtaaagccatagatacgcacctcctccacacacttccattatacagaatgattgcaaaaatgcaatttccaaagtgtaaacttcatcaaaatgcaattctcgcaaaattccggggattgcatttttttcgtgtagacttagggtagttcatcgatggacagcaccttgaaaacagaatgaccgtccgaaaagggataccccggctggggaaacaccgcaaggagccggacttcgggacaaaatgtcccgaagttgcggggagcgtgccaacgccggaatacgccgcaggaatggggcaggaaaccttttcggggagaacggcaacggaaagcaaaatggagggaacgcatgagagataacccctataaagacttgccgccgctggaacgcaggccggacggttccctttaccgcatgacaccggcgcagaggaaacaggcggccagcctgatacgccgggagtgctgttgctgtgaggacggcaactgcattgcccttgacgatggggacacctgcacctgcccgcagacggtttctttctcggtctgctgtaagtggttccgctgggcggttttgccgctggacggaacgctggaagcggagattttccgggataaggacttgaaacgctgtgcggtctgcggcggcgtattcgtccccaaatccaaccgggcaaaatactgccccggctgtgccgccagagttcacaggcggcagaaaacagaaagtgaacggaaaaggaggtctgctgtggacagttaggagcgaaaaaagccttgatttatcaggttttgcgagccccaaaccggggcgggtggtataaagtatcgcccaccccggaaaacgggcttctaaccgtccacaaaacgcactatgacaaataccatctatatccatcagccggaaaaggcgttcagcttcacccggctcccgaattttctctttgaaccccccacattcaagcccctgtccaacgaggcaaaggttctatacgcctttatcctgcgccggacagagttatcccgcaagaatgggtgggcggatgactgcggacggattttcctgtattaccctatctgtgaggtggttgacctgctccactgtgggcggcagaaagcggtgaacaccctgcgggaactgcaatacgccggactggtggagatccagaagcagggctgtggaaaacccaaccgcattttcccaaaatcctatgaagcggttccaaacaccgacttcaagaaatcccgttctggtacgccggaggactgaaaaccgtacccatgaagtacggaaaccgcccccttgaagtacgaaaaccggacggtatatagaaatacaaagattaaaatgattgatttatatccattccattcctatcgtatcagagataattccggcgggattttccctgtggaaaactccggataggaaaggaatggggaaaggagcagaatggcacaacacgcaattttgcggtttgagaagcacaagggcaacccggcaaggccgctggaagcccatcacgaaagacagaaagaacaatacgccagcaaccccgacattgacacaagccggagtaaatacaacttccatatcgtcaagccggagggacgctattaccacttcattcagagccgtatcgagcaggccggatgccggacgaggaaagacagcacacggtttgtcgatacactggtaactgccagcccggagtttttcaaggggaaatccccaaaggagatacaggcgtttttccagagggcggcggctttcctcattggccgggtaggacgggaaaatatcgtgtcgtcggtggtacacatggacgagaaaacgccccacctgcatttgacctttgttccgctgacaaaggacaaccgcctgtgtgcaaaggagattatcggcaaccgggcaaacctgacgaagtggcaggacgattttcacgcctatatggtagagaaatatcccgacttggagcgtggggagagtgccagcaagacaggccggaagcatatccccacccggcttttcaaacaggcgatttccctctccaaacaggccagagccattgaagccgcccttgacggcattaacccgctgaacgccggaaagaaaaaagaggaagccctctccatgctgaaaaagtggttcccgcagatggagaacttctccgggcaactgaaaaagtacaaggtcacaatcaatgacttgttggcggagaatgagaagctggaagcaagggcaaaggccagtgaaaaaggcaagatgaaagatacgatggaacgggcaaagctgaaaagcgaactggacaatttacagcggctggttgaccgtatcccgccggatatactggcggaactgaaacggcagcagcggcacacggtaaaggaaaggtgatagatataagcagaaattttcgccgctcctgtgcggcattgtaccttgaaaactgaatatggaggacactggatggcaaaaagcgaaagcgatatttttacaccccggacagggcaggtcatacaagcagagaacggcacgcagtattttgtatgtgggaacaaccgtataaaaatctccgaacacttcgccgcaggcggaaagcccctcggtgatctgattgtagatgtggtgcggcataccgcagaaaaagccgcttcaacctgatagcccatcattgataacacgcccacgcttatgatataattgccatagagcaaaagtattgtaagcgtgggttgtttctttagaaggaggatttttaacggtgaaacaaccttacaatactacgatttacaacacggcgctttatatgagattaagccgggacgatgaaaactatggtgacagcgtaagcattgaaacacagcggacaatcctgcaacagtacgcaaaggaacagggacttcatgtagtcggtgagtatgtggacgatggctggtcggggacgaactttgaacgcccggattttcagcgcatgatggacgatgtggaagccggaaaagtaaactgcattgtcacgaaagacctttcccgtttcgggcgggaacatgtgatgatggactactatcttgaatttctgttcccggaaaaacgggtgcgctacatcgccgttgcggagaatgaggacacagagaaagggctttccgattttgtcccgttcaaaaacctgttcaatgaatggtttgcgaaagatacgagccgcaaggtaaaggccgctttcaaagcgaagtttgccacagggcagcgtatcggtgcctatgctcccatcgggtacaggaaacacccggaaatcaaaaacaagctgataatcgacgaggaaacccgctggatagtggagaagatttttgaccttgccattcatggcagaggggcggccagtatcacaagaatactgattatggaaaaggttcccacaccgggatttatcaatttccagcgtgatgggacttttgcaaacatctatgcgggtgcgccggaggaaaaaagctacgcatggacgatagcccaggtcaagagcattatgaaagatgaaacctatatcggccataccatccactaccgggaaacgaacatttcctttaagaacaagcggagggtacgcaagccccaaagtgaatgggtgcgggtggagaatacgcaggagccgattatcagcgaacaggttttccggcaggtacaggagcagatagcaaaccgccgcaggaagtgcaaggatggtacaacgcagattttttccggattggtaaaatgtgcggattgcggctggtcgctgtcctatggggagaacaggcagaacagcaagccttacggccattatcattgtagcaagtacggacagggcacacgccaatgctccatgcactatatccgctatgatgtgctttacgcctatgtcctctcccgtctgcaatactggtcggggctggtacagcatgatgaagaacggctcttgaagcggctgttaaatgccactgataagggacaggccgccgcaagaaagaagcaggccgcagaactgaaaaaggcagagaagcggaaagccgaagtcgataccctgtttgcccggatgtatgaggactgggcggcggggcgtatcacggaatacaacttctctatgctgtccgggaagtatcaaagcgaacaggctgaactggacgaaaagattgagcggcttcaatctgctatcgccactgaaagccagaacgccgcagacgcagaaaaatggattgccttgatgaaagagtgcgtcaatccaacggaactgaccgccgaacttttgaatacgctgattgaaaaaatcgttgtccatgaagcggtcaaaggtgaggacggaagccgggaacaggaggtagaaatcttctaccgctttatcggcaaaattgattaaatgacatcaatatctttaactatgtgataccggcacgcccccggctgttcgtgtccaggatggacacattacggtgcgtgttaccccctcccaggcggtgagtgatctgctggtggaggcattaggccagagtaaggattaggggcggtttccggccctgtaacggcccaggagggcttttccggcggtctgagggtaaaaacataccacccccctctttattgcgcccggaaagccttgcaaatcaaggggtttaccacccataaatgtctacatatcagcgtgacgcatttgcagaattgtaaagaaaaacacttttatttttctttatttctgcatataatatgagtaggaaaggagtgttggatatggcacacacggtcaatgtgaattttaagttggatgaagatgtgaaaaaaaggatggaacgggcctgtgccgagatgggcctttccatgagcgctgcgtttacgatgtttgcaaaaaaggtcggcagggagtaccgtatcccgtttgaggtttcggctgatccgttctactcggaaagcaacctccggcacctggagagcgttatgcaggatgtgaaggatggcaaggcccactttgccgcgcatgacctgatcgaggtggactgatgaagctgctgtgggaggatcgggcgtggagtgattatctgtattggcagacacaggacaaaaagacgctgaaacggattaacgcgctgataaaggatattctgagaagcccctaccaggggatcggcaagccggagccgctgcgggggaacctgagcggctggtggagccgccgcattgacgaaaccaatcgtattgtttactatgagcagggagatgttatttatattatctcctgcctgggccactatgatgattgagaaaggaagggccgattatgagctgggataaagagaggatcgcgcagctgcagctccccgatccagcagacaatgacccgcacccccgtctacttctggagggggaaggcgtacacgccgggcaggggtttactgctctgttccccgatgggtggcatgacattaccctggaggtagcctgggagccggaaggccccggttgctggtacatatccacgccgggatttaagggcgtgtgtcccattggcctgttcgtgaaggtatgaaaacgatccgacagatagccgacgagataggagtatcgaagcaggcggtctataaacggtataaagggaagctgcatacggtttgcgctccgtatgcgcatacggagcagggggtcttgtatctatcggagcaggctgaaaccctgataaaacaagactttttgaaggttgaccgctccattggagcgcatacggatacgcatacggagcgctccagtggagcggtgtcggagcagtcgcaagaggacagtgtggtggcagttttacaggctactatcgacacgctgcaggggcagcttgaagtaaaagaccggcagattgaaaaattgacggaggccttggttgctgcccaaaagacggcggcagcggcccaggctctccatgcaggaacaatccaacagcagctccttactgacgaggccggagcggatcagcagggccaggagccggagccaggagaaaaacgaggctggtttagaaaattatttcgaggataagaaagtccgacaaattggaagttgcaggggcgggttattatatgaaaaaagtttttctaaagataacgctgggagtggttctcgtttgcattttgtttgttggatttctctaatcaaaaatacagaaaaacaaacttttattatttagaagaaaggatataaaaatgaaacgtttacctaaatatacgcctgcggaagtacggaatgatccatacggatttacttacaaagaaatgtcggaagttattggcgagaatgaagcaaaagccttatatgaagaattatataagcaattaccacgcaaaaaaaatctatcaatgttggtaaaaaatatttgcaaaagcagtgatactgaaaagtatgtttacgaactgaaagacaacaaatacattgaaacggtttttatcaagcggcgagatggtggaactgtttgcgtgagcacacaagtcggttgtcctgttggttgtattttttgtgagtccgggcgaaatggctttgttcgtaatctaacatcgtcagaaatcgtacaacagattatattgttgcgtcgaaaagtaaaccgtatcgtttttatgggtatgggagagcctttattcaattatgacaacttgataaaagcaatccatattctccgagatagatatgggctcaactttccaaccgacggcattaccatatcaacagttggtccggtcgatcaattaaaaaaattgcgcgaggaacatcttaaaattcagttgacaatatctttacacgcagcaacacaatctgcaagaaatcgtattattcctcacatgcgcatatatgctattgaagatgttgttaagcaagccttatcctattctgaaaggcataatcgcaaaattgtctttgcgtatttgcttttaccgggtataaatgaccggccctcagatgtaagacaacttgcaaaatggtttcggggcaaaaaagttatgattaacgtgttacaatacaacccaacaagcaattcaagaattaaagcaccacagaaacgggaaatagttgcattcaaacatcaattagagcaagcaggacttgaagttactatgagagtttctcatggcagagagattaacgcggcttgtggacagttagctaacacatataataaattcaaaaaaaaatgattaaaagtgccagacgcatagacgcagagccgataacgcattaggtcaaaaaacctatgtgttatcggcttttttatttaatattgcgcaaaagccgctgttccctattatagaatggattgcgggtagtgtattagccctcgtcccctggggagccgcccggaggaggcggggccgaagccccagccggagccggccgggagcagcgggaaaccgcagcggccggcagctccggcgatcccccgcgggagcgcgcaaaagcactttcatactgacgccccaacggggcggcggtgtgaaagtgcttttgcgttactttctcaccgagaaagtaacaaagaggtcttgcccccctgcgggggctatggtaagatgggattggtaagaggttcagacgatagaaagggtgggtgattttatcggtacaactatttccggcatgactggccggggcagcatccggcataacaaccggagcttttcagcggcgaatgtagaccggagccggacggagcagaatgtgactttttgcaacgatgatctgaaacaggtctaccatgagatcttcgacgaggccctggctgcctataacgccaaaaagaaaaagaccagggataagatccccgactactatgagcatatccgccaggggaaacaagagaagctgttccatgaagcaatcttccagatcggcaacctggaggactgcggctgcggctcccctggaggggaacgggctgcagcagctctcaaagagtttgcggagtccttccaggagcgcaatccccatctgcgggtgttcaatatggtgctgcacatggacgaggccacgccccatctccatgtagactttgtgccggtggccacggagcagagccggggcctttccacccgggtttctatgaaacaggcactcaagcagcaggggtttgtagggcttggacgcaatcagacggagtggcgagcctggatggaacgcgaaaaggcgtcgcttacggagattgcccaggcgcatgagttcgagatcatcagcctgggcggtggccgtcctcacatggaattgccggagttcaaggcagcggccaagcggctggaggctgtccaggagcaggtggcggcagcggagcaggaaatggccgaactggagcagcagaggaaggccctgcaggggacggtgcggcagctccaggctgcggagaaggtgcgggttgacctggacgcgatccagccagagaaaacgctgacaggagccgtcaagggcgttacagtggagcaggtgaaggagctgaaggcagcggcgatccgtggggccgctgcggagcagaaggtgaaagagctgaaggtagaaaatcagcagcttcatagccggatgccgtccatgaaagaaaagctgaaggaggccgaggagcggcagcggcttatcaacgaaaaccgcaatttgcaggtacaggtggagtatctggagaacagcttggacagtgagcgcaacttcgcatcccggctcctggaaggggtcgaggcggtgctggacttcctggatcggcacctgccggagcagttccggcccatgctggaaagggcgcgggagctgctgcctgtgccggagctgcaacagccggaacaggagcaggatcggggccacacctggggcggcatggaactttgataaggaaaaatctcattgataatatatagcttgtccaggggtcttgaaagagctgcctggacaggctataataacaactgaaaatagggaaaaaatatattgataatatatgccgtgtgagggggccagggagaggtggaaataaggcgggaattttggctgtcgaaaaatagggaaaaaatatattgataatatatgcccccctatgggcctttaggccctcaaagaaatctcttaaatttctctctcggacagggagaaagtcgaaggggaaaaggggggtgggcggaggctgtgggaatgtggtaaacccgaatagggttttccatcatttccatggccggagccaggggggaaagggggaggtgactttctctttaaggccccgaaggggccgctctttggctccccctttcccccctcccgcccgcaggcgtttttgtgggaacagatttttgataatttttcttctggaggtgattctatggctacggatcagcaggccgctatggagcagctgcgggcgttgtatcgggaaaaaaatgagcatctggagaagttcctggagccggtcacgccttttgagttttaccgggagatcttccccgtgggcagctttgagcggaagggccattttgaggacgaaaagggcaacgggatcgcggtgacggtgccgccaaaagccgcagggattgccttggagatccaggaggaaggcaaggccaaacgctacaccatcaccgatgaactgtcggagctgtcggaggtctacgatactgactttaccatcatgtcccctctgtcctacttcggtcggcgtcggtgcggcaagaatgctcggtatctctatgccatggtctttgacctggatggggtggggatgccccagctccgggacacgctgcaccagatgaataaggatattttgccccaggcaacctttgtcgtaaacagcgggacggggcttcacctgtattatgtcctggaggagcctatccccatgtacccgcacaaccagaaatgcttgaaggagctgaaatattctctcacccggcagatctggaacaggtacacctccaccatcaaggagccgcagatgcagggtatattgcaggggttccgggtggtcggctccggctccaagctgggtcgggagtaccccgtaacggcctaccggctcggcgggagggtgacgctggagaagttgctggagtttatcccggacagtaacggggagcagcagcggcttgaggggcttatgagaaagagccgcctgtcgctggctgaggcaaaggagaagtacccggactggtacgagcggcggattgtcaagaaggagcggcggggccgctggacggtcaagcgagatttatacgactggtggctgcaccggatcggggatgagattcgcgtgggccatcggttctatggcattatgacgctggcgatctacgccaagaaatgcgggattagcgaggacgagctgcgctgggacgcgttttccttgctgaaaccttatgacgatatgagtgtcgaggacatcaaccgcttcacgaaagacgatgtggtgtgtgccctggagatgttcaatgaggactatgtgacatttcccagggacgatatagcgaagttgtccggtctgactatgccggtcaataagcggaactggcgcaagcaggagcagcatttgaagattgccagggcaacaagggatataattcacgataattggcgggaagggaatggtcgtccatcagtccagaatagggtgtatgagtggcggcagaagcacccggaaggtcgtaaggccgactgccaccgggacacggggcttgatcccaaaacaatccgtaagtggtgggacagcacgcccccggctgttcgtgtccaggatggacacattacggtgcgtgttaccccctcccaggcggtgagtgatctgcgtgctggcaaagacctatctttccaggcagtcacccgccaagtattgtcggcacaactgagcttaacttctgtgttcgggatgggaacaggtgggacctcagcgtaataaataccagctattgaaacgacatatttcaccgacggaagtttcctcccgtatcgcctgccgcaaggctctgtatatcatcctccgcccataggcggtcatgacctctggtgacccgtgcgggaatcgaacccgcgttaccggcgtgagaggccggtgtcttaaccgcttgaccaacgggccgtctcctgcgtcccctcaaaaggttccccttcctccggtccgctctttccaacctctcccggccggaacctctatcgtgagtgccccaaggcacagcatcttctggtgcgccatcagggactcgaacccgggacccgctgattaagagtcagctgctctaccaactgagctaatggcgcatgtctttccacgcaccctcaaaatcgaacaatgaaacttccctgctttcgaaaaccaaccttcgcctggtcaagccctcgaccgattagtaccgccttgctgcacgcctcacgacgcttccacatgcggcctatcaaccttgtagtcttcaaggggtcttacctgattactcagtggcatatcttatcttgaggtcggcttcacgcttagatgccttcagcgtttatccgatccgtacttagctgcccagctgtgccgttggcacgacaactggtgcaccagaggtacgtccatcccggtcctctcgtactagggacagctcctctcaaatatcctgcgcccacgacagatagggaccgaactgtctcacgacgttctgaacccagctcgcgtaccgctttaattggcgaacagccaaacccttgggaccgaattcagccccaggatgcgatgagccgacatcgaggtgccaaacctccccgacgatgtggactcttgggggagatcagcctgttatccccagggtagcttttatccgttgagcgatggcatttccactcacataccaccggatcactaactccaactttcgttactgctcgaactgtcgctctcgcagttaggctggcttgtgcgtttacactctctggcatggtttccgtccatgctgagccaacctttgagcgcctccgttacctttttggaggcgaccgccccagtcaaactgcccgcctaacactgtcccccgaccggattcacggccgcaggttagaatttcagcacctcaagagtggtatcccaacggcggctccagcaacactggcgtgctgccttctctgcctcccacctatcctgtacatgaaataccgaaatccaatattaagctgcagtaaagctccatggggtctttccgtcttgtcgcgggtaaccggcatcttcaccggtactacaatttcgccgggcgggctgttgagacagtgtccagatcgttacaccattcgtgcgggtcagaacttacctgacaaggaatttcgctaccttaggaccgttatagttacggccgccgtttaccggggcttcaattcagagctctcactcctcctcttaaccttccggcaccgggcaggtgtcaccccatatacgtcatctttcgatttagcatagagctgtgtttttgctaaacagtcgcctggacctattctctgcggctccctttcaggagcaccccttttccctaagttacggggtcaacttgccgagttccttaacaacccttctcccgttggccttagaattctcttcctgtctacctgtgtcggtttgcggtacgggtgcctcagatatccacagagcttttctcgcctgccgccaagtatgcttccctactatatttcagtccctttcgcccggggctaccaacgcccgggtcataccctttgacagtgtccctctgcttaaatcctccggcagctacggaatctctaccgtatgtgcatcggctacgccttccggcctcaccttagctcccggcttacccggagcggacgaaccttcctccggaaaccttagactttcggccaatatgattctcacatatttctcgctactcattccggcattctcactcgtatacagtccacatgcgctttcgctcatacttcaccccgtatacgacgctcccctaccattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcccaagcttcggttacacgtttagccccgttgaattttcggcgcagagtcactcgaccagtgagctattacgcactcttttaatgagtggctgcttctaagccaacatcctggttgtctgtgcaactccacatccttttccacttaacgtgtatttgggaccttagctgtgggtctgggctttttccctctcgaccacgagacttatctcacgtagtctgactgctgtacatcaattatccggcattcagagtttgatagggttcagtaacctctcggcccctagcccattcagtgctttacctccggtaatctaatacaacgctagccctaaagctatttcggggagaaccagctatctccgggttcgattggaatttctccgctatccacacctcatccgccgccttttcaacggaggtcggttcggtcctccatgggattttactcccacttcaacctggacatggataggtcacccggtttcgggccctatgcatgcaacttcacgccctattcagactcggtttcccttcggctccacgccttaagcgcttaaccttgctgcatacatacgctcgccggaccattctacaaaaggtaccatatcacactttgacgtgctctatgtgcttgtaggctcagggtttcaggtgctatttcactcccctcccggggtgcttttcacctttccttcacagtactattctctatcggtcactggggagtatttaggcttggagggtggtccccccggcttcccacggggtttcacgtgtcccgcggtactctggatcctgccggctgtctctgtctttcgcttacgcgactctcacgctctccggtctgccttcccatacagttcagctagacttcaacataccttatgcagtccgcaaccccgcacacattgctgcatgcggtttggcctcttccgctttcgctcgccactacttacggaatctcggttgatttctcttcctcgccctacttagatgtttcagttcaggcggttcccctgacatacctatggattcagtatgccatgacggatcgttacatccgccggattgctccattcagatatccacggatcaaggcttatttgcagctccccgtggcttttcgcagcttatcacgtctttcgtcggctcccagtgccaaggcattcaccctgtgccctttgtagcttgaccatgcttgaatcttggttctctttcggctttattgcagtgcttatacccttgtttcatgatatttgcattacataaaactttgttgcagatttgtttcattgttcaattttcaaggtgcgttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccctgtctgaccagagtccgccggctctccgccggcttcgctccttagaaaggaggtgatccagccgcaccttccgatacggctaccttgttacgacttcaccccagtcatcaatcccaccttcgacagcgccccccttgcggttaggctactggcttcgggtgttaccgactcccatggtgtgacgggcggtgtgtacaaggcccgggaacgtattcaccgcggcatgctgatccgcgattactagcaattccgacttcatgcaggcgggttgcagcctgcaatctgaactgagacactttttcgggattcgcttcacctcgcggtgtcgccgccctctgttttagtgccattgtagtacgtgtgtagcccaggtcataaggggcatgatgatttgacgtcatccccaccttcctccgttttgtcaacggcagtctcattagagtgctcttgcgtagcaactaataataagggttgcgctcgttgcgggacttaacccaacatctcacgacacgagctgacgacaaccatgcaccacctgtctggatgccccgaagggcttcacctatctctaggctatgcatccgatgtcaagacctggtaaggttcttcgcgttgcttcgaattaaaccacatactccactgcttgtgcgggcccccgtcaattcctttgagtttcaaccttgcggccgtactccccaggtggattacttattgtgttaactgcggcacggaaggggtcagtccccccacacctagtaatcatcgtttacggcgtggactaccagggtatctaatcctgtttgctccccacgctttcgagcctcagcgtcagttaaagcccagcaggccgccttcgccactggtgttcctcctaatatctacgcatttcaccgctacactaggaattccgcctgcctctacttcactcaagaacggcagtttagaacgcagccaccggttgagccgatggatttaacattctacttgccatcccgcctacgctccctttacacccagtaattccggacaacgcttgctccctacgtattaccgcggctgctggcacgtagttagccggagcttcctctttgggtaccgtcattttcttccccaaagacagaggtttacaatccgaagaccgtcttccctcacgcggcgtcgctgcatcaggctttcgcccattgtgcaatatcccccactgctgcctcccgtaggagtctgggccgtgtctcagtcccaatgtggccgttcaacctctcagtccggctaccgatcgtcgctttggtgggccgttaccccgccaactggctaatcggacgcgagcccatctttcagcggattgctcctttggttgcaggggcatgtgcccccgcaacatcatgcggtattagcagccgtttccggctgttatccccctctgaaaggcaggttgctcacgtgttactcacccgtccgccactaagcttacattcatccatccgaaaacttcaaaacgtaagctccgttcgacttgcatgtgttaggcgcgccgccagcgttcgtcctgagccaggatcaaactctttgatattggtattaaaaactctcgcgagcttccaatctttaatcaaagacgatccagcttcgtttcctttgctggtttcgcttgtacgtccgtttcttcaacggatgcactcaatttcgtttccagggtccttagcttccccttccggactttctcaagcccttccggtttcacttcggttctttccttctcgttgttcatttttcaaggtgctgtgcgtgagcatatgtataaacccacaaatgacacacctcccgcttgattgataaggacagggcagcccggcgcgggcgtcatcttctatctaagcttcatctaaaatcttgcgccggggctaaataaaaattgcgaaaggccgcgctttttgtcgcgttttcctttcgcaattaatattacaatcttcattgatcaaattatgtaaattttgtattgacatatggaaaatacggtgatataataaatttcgcgatctgagttgaacagatatggcagaagaattgggggcgtagctcagctgggagagcgtacggttcgcatccgtaaggtcgagagttcgatcctcttcgtctccaccaaaagagagccagacgaacactgcgccagtcgtttacatgcttggcggagtgttcgttttggtttatccacttacaatttaaaaaaataaaaaagtctattatacagtaaaaatctgtataatagacttttttttacataaaatactataacgaaaatagttatttcctaccaaagaccagcaagattctaaaataattgttagaatctaataaaaaggagcttggctatgattaggattttactgtccacacggcttggcgagcagaggtggacgcaggcagatcttgcaagggctaccggaatcagacctaacacgattggagaactctatcacgagtttgccgaacgggtcagccttgaacatctcgatctgatatgcgaagcgcttgggtgcgagctggacgagataatcatccgtatccccaacagcgttccaaagatagagaacacaagggccgggaacaaggtacataaatgatgaccagcttatcaaagagagagtgcaaggctacggccctgcactctcttttagcttattcaccttttaccggtatcgtgtagacggtggtcgcatccatgatgtcccccggctggcattccagcaagtggcacaacttctggatggtgtcatacggcacatccaaatggcggcgcatggccttaacggtctgcgtggcaagtccgtacttcttcccgacctgtgcatcagtcagaccgattacatcaggccgcttcaggaacgggtcgaaggaaatgatagtgcgacgaatgccctctttctcaatgtcttgatacattttcagacctccttgccatctgggaacacaaagcaaattttcgctttcgcacccaaggcttcagcaacattctcccaatcttccatgctgaacttcccggtattcatccttttattcaagagctgctgggaccacccaagccgccttgctaattcggcatttgagatcccggcgtaggcaaccgccatctctacgagttgtcttacggtcatgccatcacctccatgctacgattatattctatttagttcaatttgtcaaataaaaattttaaaaaataatccaaaaagttaaaataaagggttgacaaattaaaccgaatggtttataatatgaatgtaaggcagaggtacaaaacctcttacagaagggagtgaggtgaatggacaagatggcaaacgtcagcgagtatctgctgagagcaatccttgaactgattgagaagtgccacacgattgaggaacttcgagagtcggtaaagcggatactcaaagacgagtaaaaaagaatagcggccgccccgcaaagaacgccgctactcaaacaccccaaaaggcgagccgggagccttaccccggccgcctccatgatagcagagtaaggcaaaaaaatcaaggaggcacacaaaatgaaactcgaccacacgcttgcgcgtgaaattaaggccataaatggcgatggcagccgggaggcgaggttttcttttctcaaacggctagaagctgcaaaggacgctctttccttaattggcgttggcgccaattttgacgagtgcgtaaaaaatcatgggcgcgcgaccgtggcaatctgtattgcggtcactctctatgaacgtagagaacgccttgatggatgggggcttccgtgggcattggaagtgctgaagcgatggacaaactgtgtctacgccaattatcaccgcgcatacatcgacgatcagctccatcccacgcgcatttgtaactatgccgcatcttttatccgtctgacgaccgaaaattgaaaaggagcgcactatggaaaagctgatttattctacctttcgcgagggatatggaatcgaccaaataaagaaaaccatgacggtcggcgaactgatggatttccttggaaattatgacaaggacacgcctgtttacctgagtttcgacagcggctacacctacggcggcgtcaccgagaatcgctttgaggaagattacggggaggaagcggactttgagggccaagagtggtaagggcgtcagcttcgcattacttcgcattgaccgccccggaggttacgagggcagaaaggaatctaactggaacagcttctacaatctagaggaatcgggctgggcggtggacagcaagccgcccgaaggtggtcccaggctggtccgcgtaacgctggccgacgggaacaccatcaccacgcgcatcaatggcacagatgaagaaattctggcctactatcgcgtcggctcaacgctgaatgtcggcgccgttcgtgacgatctggtggagattgccgcagtggagattgtggcaaacggttagaaatgcccctgacggccccatacttgagttgcaacggatactttgcgccatgggagggtagacgcccacccacgctcaaaaacgttctaaaaagccctctggcacgaagccgcaaaaataccaaaagccccccttgcaggaatcgttcctgcaaggggggcttttggtctaaacataaaaacatattgaatgaaaaaatttgcgtagagtaattgcatcattagattattatatcttgtcggtccccaatatccgcgtaaccgaattgagcgccgccgccaggtcatcccgcagaccctccaactttgcccttgacacgctaactgtcctatcctcagacggattggttggcacatccggcttgtcctcgcgcgcccagccattaagccggtttgccttgatgatctccggataatcccgatagcaggcgttgatatcgaccggtacggaaatgccgtccacacgccctacaaagccccgcgcgtctccatgatgctgccacatcccatagctgccagtataggtgcattttccggcgtactgtgcaacccacttgtcatatgcttcaagctgtttgtcgtccacccagtattgcagccagtttgtcgaagcgtacagccccgcgtagtacccggcgtcctccagaacctttagaaacgccttggccatgtcggtacgaagctgttttcccttgcccacgccccaggcgttaccgcagggagattcatattcctggtccatgtacaccggataggtcggacgcaggccgtcgagcgccctaacgaatgccgccgcctccttttgagcttcggcgactgttacggcatcgctccaccagtacgcgccccaatcaagccccgcggccagcactgcgggcaggtatttttgacggaacgtccccatttcccgaaggccctgcccggccttgatgatcacaaagcggacgccgtccgccttcacacgttcaaagtcaatctctccctgatgcgatgaaatatcgatacctttaatctccatagtttaccgttcctttctgacatataaaaaccgctgatcgtttccgatcagcggtttaaaaatctgctgttaaacatacaacactttgcatctcatttgtttttcgccatgtcttccaagcggtactttccattttttgcataaaataaatttaatattttatcatatttaaacaagtatatcaatggacctgccgcccttgtaacataataccacaaattcatacaattatttccataatctgttttaaacagtcaggaggaaataattatgaagtatgacgaatgcagagttattttggcgtgcaacctttttgaataccgcacaatcaatggacccagccaggaagatctggcgtatcaaatcgggattgaagtcaaaacctatggaagaatcgagcgggcggaggaacatacaaatttagaaatccttgaccgtatcagccgtggaactggtatgacgcctgctcaattgttgacacccttctatgaaagcattcccgcggcttccaatcaataagccgcgggccaaagggcctgcggcttgacagatatccctggtacggatataataaaaacaaagaggcgctgtcgacagacggttagcccaaataaagaggaaaagtaaccgcttcatttggtcgtgagggcggttacttttttatgtatttcacggcttctgtgatcgccacgaccaataaaatcgcgagcaacaactcaaccatacataacaccccctttcgcaagggagtgactaaccgcctgccgtttgcgacagcgccagcattattttaccatgcgccgcccttttttacaagccgatatccgcattgattgcctttattcgtcacgattcggcgtcttatatccgagcgcccgcctgctgtccccgacgccggccgtagttgggtcggtcacagcgttaaacacgctggccgccgcagcaagcagcacaacgggattctgcaccgcgcgcagaaacacatcccacagcgcgccccaggaggtcatatcctcccaggccaggccgaagtatgcgagcaccggcagtaccagcgccgctgctatctgcacccaccacagcgggtttttaatgcgtaccttccaattgatcttcatcgtatttcctccagtctcacagccccatccgtcccagtacaaaggcgatcaccgccgcgagcacggcccatatcgctttgtcggcaaggctctcccaccgtttcgccggtttttccttgagtgccgcgatagtcgctagcgcctcattaagccggacggacagttccgtcaattaacgagcagccagcggaacagatcaagccatttgtttttgatgtatggcgtgcgcagatcgtccacacgcagccgcaaggggttaaaatgataacgaatgaagaaataggccagcgcgccgaatagaagcgcacagccgccgcagacgatgattttaacagccagaccgagaaaagcgccgatgggcgcaaacatgtttccaaccacagaacccatatcgatcattaagacacccccggtattttgcggattaaccacatcaaaatagaccagacgaatttcaggttgtagacgatcaacagaataatcatgcagcggctgagaagggacacggatataaacatattgacgaatttgaccacatggagcagcggcgacatggaggcattcaggccgtcaaagctggggaatttcgggaacaggttgattaaaaagtgcgccagtgcaaagaagatattaaagaaaagctcaataatcacgcgctatccctcctcggtgaagaaatgccgcagcttatgatagcagacaatcgccgtgaacaggcaggcgctcgcatttaaaacattgcgcataaaatctatatatgggcgagctgacgtaaagaaatcaacacttgttccacgatagccgggaaacagaaaattattcggtatcgtaaggttaaggctcacattgggaggactggcaagtatcttgaaaaagtcgttaatcatctggtaaagctggcccagccccgcgaaacggctgttgacatggtcgttcaagctggaaagctgatcgttgaaataatcgccgtccggtacaaacagattacggataaacattccgatatctgcgagcgtgtcaaaaaatccccggctctggccgtccgcagcaaggacagggacggacaaagtaaacgcgaccagcacggccaacaggatgatcaggcttttttgtttcatactaacaccgccctattccttatgaataaacattttagaaatcagtccaacagaaagtacgattccaagtattttgataccgatatttgtaactgacgcgtaagacatacggacgcttccagagagatagtccaatgattcgctgttcaaaactgtccggggcatatcataactaggcggtggccaagacaaagcatgaactggaagtgagtataagcctaaaataaggatgacaagaatcaaagaccatctttttttcaaagcttcggcccccttccaacaaaactgattatttgtataactgcgtaaatagataaggaaatcataaaaacagttaaaaaaacgctaaaaatagttcctgcgttatatcgcaatgtgtaaaaaagctcatacaaagcgtctttagaaaaaactacatattccaaagttgatcaactccatggaaatgtactatgccattgtgtatcaggtgcaatatcgaaccagttgaaaggacttccccacgtagcattcaatgaaatatcataccattcaaacggactgctccaatcggttccgggcgaaatatcccaagggtcgtcggaacctgtaccaccggatgactttgcgtagataactgtaatcgtcaaatcactgtctggcatcataccggaaaccgttggtttatctgcagtataatcgctcaaaacaggggaaacgacctcgtatgaatcgcctgccgcaagagatcgtatagccggttcggcagcctgtgaaccgtcctcgtactggtattggatggtcagggtatgctctgccggtgtgggaggtatcgccgtatatgtaacggtaatcgtcaagtcattgtccggcatcgtcccggaaaccgttggtttatctgcagcataaccgctcaaaacaggggaaacgacctcgtatgaatcgcctgccgcaagagatcgtatagccggttcggcagcctgtgaaccgtcctcatactggtattggatggttagggtatgttttgccggtgtgggcggcgcttcaaaaacaatgttctttatatcgcttgcaaaagcaacatcggaaggtaattgcgtaacagactgattcgaccaaataaaaggctgatgcgggtaactgctataacctgtaactaacgcccaaaaagatatggaatctgacgaatgctgaaataatgaccagttttccgtttcaactgcatatgaaaatgtaataatgcgcgtagaagcagatttaaaagtgtgagatgtgctgacagtacccggctttactgtgacagcattctttttataatttaacgtcgccttatcatgggaatggacagagatcgtgatatcctttccattctccgaaagaccaaagccaaagagaacaacccggctgtcatcgttaaaatcttcctttatctgctgccagacacgacgggattcatcattaaatatttcatccggcggcgaaaaaaggtattcgccgtcagagccttcaatataaggcatggccttgacagcagtatcaaaccacgttggggacagatcagccgcaaaggcgggaagcgaaaagcccgccgcgcatacggctgcgcagacgctcgctaagaaccgtttccattttttcatgaatcatcactcctgtatttttcgcccagtcgggcacccaccaagggttgtgataaacgttgttgtccgggatatcgaggataaagaaaccgccctctaaaaaagaaaggcggtgaaaatgtgcaaagcaaacggctttacgacctgctgtgtttcatcatggcaaacccgcaaaaccgctacttctgtagataccatgctggaacatggtatctgcggatagcggaataaagagctagtcctttttcccattgcaaaaaggcggtttctttatccacccaaataatagcaaatccatcgaattttgtcaacaggaaaggaaaacagaacgaatgaaaacgttatataaagtagagatgcagcgaagcaatattaccccaagatcattttttactgcctgcaccaaagccatgcagaaaaagggtgcagatatagccgattggacggattatgacagttggacaaacgatcgtcaaacaccctattacagcaaagaaaaacatgaggattgggacgagccccgctgtgaaatttattcagtagccccttacaaaatacaaatgtttcttgccagcgcatataatttcattcttgaattcgacttcgatactgacaaaaaaggttctggctatctgtttgcagtggaattcgaaagatgataattacccgccccagaggttacgagggcagaaaggataactaaccatgaaaaaagaaatcaaagtcgagtggtgcgagaactttatcaaggcccggttcacaaagcaccacgcgttcccgggtccgaatgccggaattgaggtcaactgcttctggaagatggcggaagcctctggcttgtgggagcgcggtacctatggctctccgatgagcaaggcactcggaaatcttaccaaggtcgagattgtccgagatggagaaggaaaattcttgttcaacgcattcaaactggcgtaagcaccgcccgccccggaggttacgagggcagaagggaggaacagcatgaatgaacccgtatacagcaagatttaccccgccaaacgctgcgaataccgatacaactacatgacgcaaaagctggaacgaatcgaaaagcatgtctgcatgaagcagatcaacggcgtaccctgctccgtcgtggaatcggaagtgaccgccgaattcgatgtgcgccgccaaatgtgggagaaaatgcccggctactgggtgcagctttacgacagcttgccgaatgaaagagcgtacccgttccggccataaaaggaaacgacagccgccccgatcggggcggctgtctcgcgttaattctccccccggtctttgcgcggggagaactgtattttttccatgcgccgaatcttttcaaacgtgtcatagcaggcacgtaaagcgtcggactgtacaaagcttgccttgtgcaggggtttgaccttgcgcttgaccgcaactggattttcaataaccatggcatattgaagcgcatcgtattcgcggtttctggtcagccgtcccgcccatgtggagcagctaaccaccgtcgcagcctgctcacgcaaaggctttgcgacccgtgtaaaaaactgcgccgtcgccacgatcttcacccgctgcttgcgctgctgcgacacctcggaaagcagcgattccggcacgtcgttccagcttttggccgaatactccgaatggatttcatcaatcgcaaagataatcccgtcggataaagaaaccgccctctaaaaaagaaaggcggtgaaaatgtgcaaagcaaacggctttacgacctgctgtgttttatcatggcaaaaccgctacttctgtggataccatgcgggaacatggtacctgcggatagcggaataaagcataacccttaacccatagcaaaaaggcggtttctttatccacccaaataatagcaaatcaatcgaattttgtcaacaggaaaggaaaacagaacgaaagaaaatgaaataaaggattgtgtcaaatgaaaaaatatgagcttacaggggaaaccatcaacgtatttggcaagacactgcaccgcattagggccacaagggacttttctaatgtgcatgctggtgatttaggaggatttatagaggatgaacgcaatttaagtcatgatgagaatgcgtgggtcggcggcaatgcgcgggtcaaaggctatgcatgggtcgacggcaatgcacaggtcgacggcaatgcacaggtcaaaggcgatgcgtgggtcggcggcaatgcgttggtcggcggcaatgcgttggtcgacggcaatgcggtggtcgacggcaatacggtggtcggcggcgatgcgctgatcaaaggcgatgcgctgatcaaaggcacgcgggacatattttggatatcccacatcggctcgcgtaacggcacgacaacatttttccgcaacgcagacaacggcatcagcgtatcatgcggatgcttttatggcacaatcgacgaatttgcagccgcggttacaaagacgcatggagacaatgagcacgcgcaggcataccgtcatgcgattgagattgcaaagctgagaatcgaattggaggttgccaaatcatgaggcgcgcaggatatatgaattgaaaaaggaacgaaaggaaatcgctatgaatgaacctgtatacagcgatatttaccccgccaaacgctgcgaataccggtacaattacctgacgcaaaagctggaacgaatcgaaaagcatgtctgtatgaagcagatcaacggcgtgccgtgttccgttgtggaatcggaagtgaccgccgaattcgatgtgcgccgccagatgtgggagaaaatgcccggctactgggtacagctttacgacagcctgccgaatgaaagagcgtacccgttccggccataaaaggaaacgacagccgccccggccggggcggctgtcttgcgttaattctccccccggtctttgcgcggggagaactgtattttttccatgcgccggatcttttcaaatgtgtcatagcaggcccgcaaagcgtcagactgtacaaagcttgccttgtgcagcggcttgaccttgcgtttgactgcaaccggattttcaataaccatggcatattgaagcgcgtcgtattcgcggtttctggtcagccgtcccgcccatgtggagcagctaaccaccgtcgcggcctgttcgcgcaaaggctttgcgacccgtgtaaaaaattgcgccgtcgccacgatcttcacccgctgtttgcgctgctgggatacctcggaaagaagcgattccggcacgtcgttccagcttttggccgaatactccgaatggatttcatcaatcgcaaagataatcccgtccatttgtaatcaagaatcttgcggggataacggttcatccaatcctgaatgcgttggatgtcctgttcgctgtagttctctatcggcgttcccttgggtataaaacgccgaatcatcgcgtttgcgttctcattggaaccgcgctcccaagcggaatagggatgacaatagtaaatctttgtccgttgggcttttgagcggtaagatttctccatccccgtacagtccataaactccgcgccattgtcaaccgtgatgctcttaaaaagcaaagggaaccgccgcccgtacctgcgttccagacggttaagcgcatggacgacctcggctgttgtcttatgccgcagcttcataatgatttcctgccgcgtggagcgttccgtcagcacaagcaaaacctgtccttttcccttggccttgcctgtgaccgtatccatttcccaatgtccgacctcaatacggcgctggatatcagccgaccgggcctctataccttcgcataggggcttttttgtcctgacatgaaccttgcaatatggccgcctggaatccttgcggcgcggcagatgttcgttggagagccgcaggaatacacgccggtcaatgtagttgtacagcgtcttaacgcagaccgtcgtctgaaaagccagcccccgcgcccggatttctcccaaaacagcagccggagaataccgctcggaaatgatcttccgttctatgtacgccgcaaacgcatgatcatccccgattttaagctgcgcgcccttggccgtggccttgtaatcatagtcctgctgtgcaatgtccgcgctgtaagcggataccgtctcccattcggaggttaaccgtttgtagctcccccgtttcagttcccgatagaccgtactgacagaacagcctatatacgccgcaatctccttaacgcatgtccccgttttctgtaatgcctcaatcttaatcctgtccgcatatcctaaatgacaaaaagtccccttgcccttcaaaacaaacaccccgtcgcctttacatgccgtttgtgtccctgcctcatccttacatcgaatggggcaggtgcttgtaccacaggcttggcaaaccgtcaataactttcgcggattacaaaacagttacaaatgcaggtatcgggaaaacctgtcagagcgtgctaaaacgcatttgtaaccattttgtaacccacggtctattgactgtccgccgcgcccgcggcctccttgtaaacaaggaggggcaagcccctccacccccggcgacggggcaactccaagcttggggaacggggtaagcgcggataaagaaaccgccctctaaaaaagaaaggcggtgaaaatgtgcaaagcaaacggctttacgacctgctgtgtttatttatcccgaggcttattttgtggaagcaggtgtttcatttgccgggaaagcccaaacgcatacacaatccaaacaacaggaggaatacagccatgtatgagacaagcattttaagcgtacagcagacaactttcaagggcagagacggagaaccagaccggattatgtggaaaatttactgcgccgacagcacaggcgcggtcggctgcatctattccacgaaggaacgcaaagccggtgaaatggcccaactcgaccttgtggtaaaccgtgacggtcgctttaccgcaaagcttttggattagcccgcctttaggggcggcgtccataaccgggttgccgcccccgaagggggcgctacttgataagtgccacaaagtgtcatcacatcagatgattgcattttgtccccggcaatggactatgaagttaaatacaactgcaaagtccgttattttcctgacaaccaaatcaagatcacatgcttttcaagacctgtattcaatccactgaaagccgaactttacggaaccgaaccaaaagaactcgtatccttaaaagaatacgacccggagactggcgaaatggcttacaaatttgtagaaggaaagacaatttactccccgtttgaagaccggtacgtcccgattaccctgtataaagagccgggagaaaagaggacgcgcaccgacagcgtcaagcgggcgatcgataaggcgtttgaaatcgggctggccaatcagttccggtacttcataacactgacgctcgatcaggagaagatcgaccggtatgacacggcgaagatttacccgaggctgcgcgtctggttgagcaacatggtacagcgccacaaaatggattaccttctgttcccggaataccacaagccccgccccggtgaaactgaatgcgcgatacactttcatatgctcgcgaacgcggacaggctgaacctttccgacagcggcagacagacggagaacggacaggcgatctttaaccttccgggctggaagtacggctttagcaccgtcatagagctggacggacggcccgcaatcatcaagtatgtgacgaaatacatcaccaaaggcaatgctaagattttcggcaagttttatctttcaggcggcaagacgctcaaacgggaagtccccgccgaattcatgaatattgattacgcatcgttcgagggacaggaatacacaatccccggtacgggtatgcgggtcaaatacaagacgttcaatttagattgggatcgcaggaaaataccggagatcaggcagacggagaaaaccacaccggctatccgcagccccgtactggaaagcgccccgtatgagattttaaggctttcggaaagataatcaaaggacgattcgcttaacacagtccggggcatgtcgtaattgggcggcggccattggatttctgcaaagcacgggacggagcagagcgccagcagaaggattaccgccagaaaaactgcggattttttcacgttgtcgcccccctctatcggctaacatggtcaataatattcaatactgcataaacgcccataacgatcataaatgtccacaggcagacgttaaaaatagaaccgatgtttgtccagatggtgaacgacatttcattgagcgcgtccatagagaaaacaacgtattcctcattgatgagaatcacccccaggcaaatggattggggaagtcaatatgaccagcaacatcaaaccattcaaaagggctgggccaatccagatgagcgccaacatcggggaatttcccgagagaacttccgccaccctcggaaccagaattattattgtacgttacaacaatccttaaattattttcaggcatcgtaccggaaaccgttggcttgtctgccgtgtagcctgtaataacaggggaaacgattgaatacggtgtgccagcctccagatgcttgattacaatatctgaagccggtgtaccgtctgaaaactgatagacaaccgatagtgtgtataaaagctcgcccggtacaggcagatatgtaacagtaatcgtcaggtctttgtcaggcatcgtaccggatacaattgcctgatcggtataaaacccgccgatgacaggcgataccacctgatatgccgccccggcctcgtatgttttgacaaccggttcggcagcctgcgagccgtcctcatactggtattggatggttagggtatgttttgccggtgtgggcggcgcttcaaaaacaatgttctttatatcgcttgcaaaagcaacatcggaag
